United States Patent 7,745,391 (HUMAN THROMBOSPONDIN POLYPEPTIDE) - sequence listing, part 115

SEQ ID NO: 332386 - DNA, 9481 bp, Homo sapiens
ggtccaggcggcgcgcacggtatggcggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaagaaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaaccatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaaccattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaaggtaaaacttttacagctaacatatctaaaactgtgagacgtcaaagacaaagcaaacgccctaggttaagtgtggatgataatgactgggaggatttggactatgcaaaatctaaaagagttcttcgacgttcaaaaataaaaacgagaaatcagggtagaaggactgtgagataccatgatggggatgatgacagaagtttagaaaatgtgttagatttcaatggttgcaccttatgaccttgagggaaagccagttcatttaagaggaaatggactggcatttatggtgaaagctggctgttaaaattatttttttgtcttacaattcagggaatatatttatatttttctatgaaaagttatgaatgtgactaaatcatgactgttatttttatttgcacttgctggtctttgtagcagcattcagcacaggtgccaaaatatgcttcattttgggggcagatctattttgacagtatttgactacatatagcaagagtttgaaatatgttaaacactagacatcctggttatcaaaaccaatgagcattactttcatggcagcaagtgtcatgcagttattttctgaatttgtcaaagaggcagtagtttctaacccctgttctatagtagttacaacaatttcacaacctatgtttacagattcttcataaatacatgcatactgacactataatcatgggaggtgtaaccatgattagtaggcgaggtacctaccacttttttttttttcttcccctggctacttgagtagaatgcattataccagatctggtcactttcattgaaatggtttctaattttcttcccaagtgctgttgggtttttttcttcttaaggaaaacgttgtcacttttatgttataaacttgaatttataaagtgctggtaaattatttttaatgatttgagtgcatgttttaaacctctaggaccagagcatagtcagagcattttcttttaaattgtgcactaacaaaatgctatataatctgtcttctgtccaagatctcctggtttccattgtaagggatttaaccaaaatcttgctcttccataatcttactctgtgaaatagaggaattcgtgtgccttagatttagaagtgtgttctttaatagagtgtacagggctaaaagagtatttaagttaatatgtaggtttcccccatctgtattccaattgtagaggtgagttttgttaagagtacaattgcaaatcttatctatataggaaaatagctaaatgtcattctccatctctttgttttagtttactgcttccatgtgcaatcctaagcattctttgctggggcaactaaatgtatctttattagtgacttctagtccaaatataagaaactgtcatgttttgtgggaaaataattttataatccatttaaagtgaaagtttatcacacaaatagtacacttattttctaaccaaatacttgataggttatgctactccagtgtagatggccattcctaacttgtttgtgcctgaagatggacttgattcaaatggtttacatatttagtgggtaagggatatgttacagtaccccacctgtaagttatttattagccctaattgtgtttgatttcagacaaaattaacccttttctcctgtgtatctttgaagtggcagataaggtgaagcatcagactggtatcaatattagacaatgttatttattagccctaattgtgtttggtttcagacaaaaccttttctcctgtgtatctttgaagtggcagacaaggcgaacatcagactggtattaatgttagagaatgttctgaagtgttcctattttgtagttatctattccatttgacatagtagaaggtacattttctttctactctgatgcatggggaaggatgtttttggacattatcaactgagataggtgggaaacctcctctcatttgtggcttagagagctatcaccatttcagaactatgatgcttttcttctcagaacttgtgttaagtagatagtaaacagattgattcatgataattgtccttgactaagactgaaaagactaatgggatgccttttactttgctaattttaaaaactggtgatagatgtcaaatccattaatttatttaaactcttcttaaccttctcttttataatctgttctcaggttttaactccatgtttaccatcatttgcaaaaaggtaccaaaaaaatccataaataaatatggaatacattcataagtacatacattcttttggtataaaacaatattttgacagtttaggcttcattaatagaactattctgattatttggactgcattaattggtcactgactggccatccaattaccattttttctttcagtccaaaatagttagacccttgcatacagaagtggtattttggtttttaatcagatttggtttcatcagaagcagcaagaatggacctgatgtctttaaaagcatagccgacaatggtagcttctcaagttatgaaataaaactgagagataatggagaaaataatttttatgggtttttttggttatggtgctattcctaaggttaactttgaatatgtgacacacacactcctaagtacctttaagtccaaaatagttagacccttgcatacagaagtggtattttggtttttaatcagatttggtttcatcagaagcagcaagaatggacctgatgtctttaaaagcatagccgacaatggtagcttct

SEQ ID NO: 332387 - DNA, 2501 bp, Homo sapiens
ggtccaggcggcgcgcacggtatggcggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaattgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctagccatgtcaccctgtggcactaatcaggacactgtttatattcttcctcttctgtgtccctattcactttgtaattattctattttagctggttatatggtagttaattggtagcctgttttcctttgttttctttacttgtgtcaagctccatgtcgttgttttgtgatgagcagtgatttagaactggccagaccttagaagagtcttcagcaagctgccctagggtaggggcatattctctgtttgttttgtactggtaccccaggaggatgccttgtaactgctctttggtcatgatagtggtaatgaatccattcatgtaaaatgcaatatgtctgttagtttggggcacccgaggctcagtagaggtttagtatgatgccttccctttcttctttgagttatgaagaaactaatttctggcacagtgtgactgcttcaaacctatgttctgctgctatctcctatagaggagggcagacttttttttcttagtgcatttgctggtaggtcaaggagggatggactttgaattagtgttcagagtcacagatcctacgtatgtgctcttcagtagaggattttctgtgatcctacaatgaagggaaagctatataatttattggtacttcctaaagatagagactaaagtcatggtagtattggccaaattaattttaaaactgaacaagtcatgaattttcatataaatcaaagaactttttccttataaaagcttccatttttgaaaagttggatcagttgtaagacctttcatctttagtattgtatgatataattctacattgaaaaataaacacttggcattaaatgggacttggagtcaaaagatctggttttatggtccatctttaccaatcatttgctgtggatctctttaaaggtcctggaacctttgagcctcagttacctcacttgtaaattggcaaaaatacctacctcacagggttgttgtgaggattcaatgagctaatgtatgttgaaagcactttgtgaattgtaaagtgctacacaaatgttagttgttgttgctgctgtatctgagatgtcttaattttctttttcttcagaaatagtctaataaacctccagggcttttctgttaaagtatactagttggtaaaatgttgaataaacagtttattacaatataaaaaaaaat

SEQ ID NO: 332388 - DNA, 3174 bp, Homo sapiens
caaaatagacggggacatgttacagtaggttagaagatcaacagtgctatggaggaaaagaacacaggaagagtaaaagagaaatgggcacagagtgaggataagtttaaattgtacttagggtggttagggaaggtctcactgaaaatgtgacatttgagccaagacttgaaggaggggagggactcagccatgcagtttttccaggagaagagcattcctgcagaacaaacagcaagtacaaataccctgaggcagccgtgggccaggtcacgccacagtgaggctggagcactatgagaaggggagcagtcaggtgagaggtaagacaaaccagagagaggccagatcgtgtggacttggccttttcctctgggtctgatgggagcctctggaggattttgagagaggaaggacaagtccgtctttagtttgtttttttttttttcttgagatggagtttcgctctcgttgcccaggctggagtacaatggctcgatctcggctcactgcaacctccacctcctgggttcaggcaattctcctgcctcagcctcctgagtagctgggattacaagcacacgccaccatacccggctaatttttgtatttttagtagagacagggtttcactgtgttggtcaggctggtctcaaactcctgacctcaggtaatccacctgccccggcctcccaaagtgctgggattacaggcatgagccactacgcctggccctgtcttaagttttaacaggatccctccagctgcctgagaatacacagaaataggatgaaggtagaagcagtaagacataagaggttgtggtgctcttccggatgagaagtgcttagattctggatacattttgaagagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaattgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctagccatgtcaccctgtggcactaatcaggacactgtttatattcttcctcttctgtgtccctattcactttgtaattattctattttagctggttatatggtagttaattggtagcctgttttcctttgttttctttacttgtgtcaagctccatgtcgttgttttgtgatgagcagtgatttagaactggccagaccttagaagagtcttcagcaagctgccctagggtaggggcatattctctgtttgttttgtactggtaccccaggaggatgccttgtaactgctctttggtcatgatagtggtaatgaatccattcatgtaaaatgcaatatgtctgttagtttggggcacccgaggctcagtagaggtttagtatgatgccttccctttcttctttgagttatgaagaaactaatttctggcacagtgtgactgcttcaaacctatgttctgctgctatctcctatagaggagggcagacttttttttcttagtgcatttgctggtaggtcaaggagggatggactttgaattagtgttcagagtcacagatcctacgtatgtgctcttcagtagaggattttctgtgatcctacaatgaagggaaagctatataatttattggtacttcctaaagatagagactaaagtcatggtagtattggccaaattaattttaaaactgaacaagtcatgaattttcatataaatcaaagaactttttccttataaaagcttccatttttgaaaagttggatcagttgtaagacctttcatctttagtattgtatgatataattctacattgaaaaataaacacttggcattaaatgggacttggagtcaaaagatctggttttatggtccatctttaccaatcatttgctgtggatctctttaaaggtcctggaacctttgagcctcagttacctcacttgtaaattggcaaaaatacctacctcacagggttgttgtgaggattcaatgagctaatgtatgttgaaagcactttgtgaattgtaaagtgctacacaaatgttagttgttgttgctgctgtatctgagatgtcttaattttctttttcttcagaaatagtctaataaacctccagggcttttctgttaaagtatactagttggtaaaatgttgaataaacagtttattacaatataaaaaaaaat

SEQ ID NO: 332389 - DNA, 9730 bp, Homo sapiens
ggtccaggcggcgcgcacggtatggcggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatggtaggtaatttctggtacaatgtaacaaatgagattttttgaaatatgattgtaattttgaagctataaaaataatatattgaacaagttgtttctctcatgtaaactatgaaatgattagaaatttttataattataaattattgtcgaatacatttctaaaagtatatgctgtaacagtatgtatttttaaattttcaatttgtaacttgtaaaccctccttaatgttatgactttgttaaataaagggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaagaaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaaccatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaaccattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaaggtaaaacttttacagctaacatatctaaaactgtgagacgtcaaagacaaagcaaacgccctaggttaagtgtggatgataatgactgggaggatttggactatgcaaaatctaaaagagttcttcgacgttcaaaaataaaaacgagaaatcagggtagaaggactgtgagataccatgatggggatgatgacagaagtttagaaaatgtgttagatttcaatggttgcaccttatgaccttgagggaaagccagttcatttaagaggaaatggactggcatttatggtgaaagctggctgttaaaattatttttttgtcttacaattcagggaatatatttatatttttctatgaaaagttatgaatgtgactaaatcatgactgttatttttatttgcacttgctggtctttgtagcagcattcagcacaggtgccaaaatatgcttcattttgggggcagatctattttgacagtatttgactacatatagcaagagtttgaaatatgttaaacactagacatcctggttatcaaaaccaatgagcattactttcatggcagcaagtgtcatgcagttattttctgaatttgtcaaagaggcagtagtttctaacccctgttctatagtagttacaacaatttcacaacctatgtttacagattcttcataaatacatgcatactgacactataatcatgggaggtgtaaccatgattagtaggcgaggtacctaccacttttttttttttcttcccctggctacttgagtagaatgcattataccagatctggtcactttcattgaaatggtttctaattttcttcccaagtgctgttgggtttttttcttcttaaggaaaacgttgtcacttttatgttataaacttgaatttataaagtgctggtaaattatttttaatgatttgagtgcatgttttaaacctctaggaccagagcatagtcagagcattttcttttaaattgtgcactaacaaaatgctatataatctgtcttctgtccaagatctcctggtttccattgtaagggatttaaccaaaatcttgctcttccataatcttactctgtgaaatagaggaattcgtgtgccttagatttagaagtgtgttctttaatagagtgtacagggctaaaagagtatttaagttaatatgtaggtttcccccatctgtattccaattgtagaggtgagttttgttaagagtacaattgcaaatcttatctatataggaaaatagctaaatgtcattctccatctctttgttttagtttactgcttccatgtgcaatcctaagcattctttgctggggcaactaaatgtatctttattagtgacttctagtccaaatataagaaactgtcatgttttgtgggaaaataattttataatccatttaaagtgaaagtttatcacacaaatagtacacttattttctaaccaaatacttgataggttatgctactccagtgtagatggccattcctaacttgtttgtgcctgaagatggacttgattcaaatggtttacatatttagtgggtaagggatatgttacagtaccccacctgtaagttatttattagccctaattgtgtttgatttcagacaaaattaacccttttctcctgtgtatctttgaagtggcagataaggtgaagcatcagactggtatcaatattagacaatgttatttattagccctaattgtgtttggtttcagacaaaaccttttctcctgtgtatctttgaagtggcagacaaggcgaacatcagactggtattaatgttagagaatgttctgaagtgttcctattttgtagttatctattccatttgacatagtagaaggtacattttctttctactctgatgcatggggaaggatgtttttggacattatcaactgagataggtgggaaacctcctctcatttgtggcttagagagctatcaccatttcagaactatgatgcttttcttctcagaacttgtgttaagtagatagtaaacagattgattcatgataattgtccttgactaagactgaaaagactaatgggatgccttttactttgctaattttaaaaactggtgatagatgtcaaatccattaatttatttaaactcttcttaaccttctcttttataatctgttctcaggttttaactccatgtttaccatcatttgcaaaaaggtaccaaaaaaatccataaataaatatggaatacattcataagtacatacattcttttggtataaaacaatattttgacagtttaggcttcattaatagaactattctgattatttggactgcattaattggtcactgactggccatccaattaccattttttctttcagtccaaaatagttagacccttgcatacagaagtggtattttggtttttaatcagatttggtttcatcagaagcagcaagaatggacctgatgtctttaaaagcatagccgacaatggtagcttctcaagttatgaaataaaactgagagataatggagaaaataatttttatgggtttttttggttatggtgctattcctaaggttaactttgaatatgtgacacacacactcctaagtacctttaagtccaaaatagttagacccttgcatacagaagtggtattttggtttttaatcagatttggtttcatcagaagcagcaagaatggacctgatgtctttaaaagcatagccgacaatggtagcttct

SEQ ID NO: 332390 - DNA, 1957 bp, Homo sapiens
ggtccaggcggcgcgcacggtatggcggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaattgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgatatgatgccttccctttcttctttgagttatgaagaaactaatttctggcacagtgtgactgcttcaaacctatgttctgctgctatctcctatagaggagggcagacttttttttcttagtgcatttgctggtaggtcaaggagggatggactttgaattagtgttcagagtcacagatcctacgtatgtgctcttcagtagaggattttctgtgatcctacaatgaagggaaagctatataatttattggtacttcctaaagatagagactaaagtcatggtagtattggccaaattaattttaaaactgaacaagtcatgaattttcatataaatcaaagaactttttccttataaaagcttccatttttgaaaagttggatcagttgtaagacctttcatctttagtattgtatgatataattctacattgaaaaataaacacttggcattaaatgggacttggagtcaaaagatctggttttatggtccatctttaccaatcatttgctgtggatctctttaaaggtcctggaacctttgagcctcagttacctcacttgtaaattggcaaaaatacctacctcacagggttgttgtgaggattcaatgagctaatgtatgttgaaagcactttgtgaattgtaaagtgctacacaaatgttagttgttgttgctgctgtatctgagatgtcttaattttctttttcttcagaaatagtctaataaacctccagggcttttctgttaaagtatactagttggtaaaatgttgaataaacagtttattacaatataaaaaaaaat

SEQ ID NO: 332391 - DNA, 2193 bp, Homo sapiens
caaaatagacggggacatgttacagtaggttagaagatcaacagtgctatggaggaaaagaacacaggaagagtaaaagagaaatgggcacagagtgaggataagtttaaattgtacttagggtggttagggaaggtctcactgaaaatgtgacatttgagccaagacttgaaggaggggagggactcagccatgcagtttttccaggagaagagcattcctgcagaacaaacagcaagtacaaataccctgaggcagccgtgggccaggtcacgccacagtgaggctggagcactatgagaaggggagcagtcaggtgagaggtaagacaaaccagagagaggccagatcgtgtggacttggccttttcctctgggtctgatgggagcctctggaggattttgagagaggaaggacaagtccgtctttagtttgtttttttttttttcttgagatggagtttcgctctcgttgcccaggctggagtacaatggctcgatctcggctcactgcaacctccacctcctgggttcaggcaattctcctgcctcagcctcctgagtagctgggattacaagcacacgccaccatacccggctaatttttgtatttttagtagagacagggtttcactgtgttggtcaggctggtctcaaactcctgacctcaggtaatccacctgccccggcctcccaaagtgctgggattacaggcatgagccactacgcctggccctgtcttaagttttaacaggatccctccagctgcctgagaatacacagaaataggatgaaggtagaagcagtaagacataagaggttgtggtgctcttccggatgagaagtgcttagattctggatacattttgaagagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtgagcattgggcacgtttgctccccgggttttccgtgcaccgccccccgcccccgccccttcccctcgcggggaccccggcccgtggggtgcaaagtgtgacccgcactggggggcggcccgggcatagctgcgttcccggctgaagattttgttttgtttttgaggcggccaggtttgttttggcaggaaacagtcattgggggcggcgcggggcggagcggtgggggcgactcgcggaggtcctgcggcaggggtggggctccaggtgcggccgcctctgcgggggtgtggcgtgcgcagccagccattcaactgggcggtttcattcgcttccccactccaccgcgcttgtaactcgcgctctgattggcctccctgctcttgccccgcccgggtctgtccccccacttgttccctaggaatagaatcattggtctctgaaggtggagaaatgttcttgtgttgagctttttattttttgttttgtcagcagcgtcataaaaatcttgcagctgtatgaatatgccactgtagtgcttgtgctcctttctactgtacaatatttgttgaacgcagtagttgattgatgagtttcacactgatcttgtagataacacaataaagtgctttaaataggcacttttcttttgagctcggttaatcttgcattacagtctcatttcttttgtgaacttggttaatgtttctatataacttgcttttatctatagttacagcagttgcagggattcgtttgtttttactggagacatttttcaggaatatatttttgccgtttcgttattaggataaaggaattcattaattgccaggccatattcagcatcttgtataaggaaaacaattgagaaagaaaagagcttctgagtgatcttttaccacagttggaagacctgtaacacttgagtggtagagtatggtggcaagtgaaaagaagaaaaaaaagtggtagaagattactggttttgaattagacaacagaagagaccagaggatgtgttatttccatgaacagttaacacttgaagcctggtgcaagtaataaataattttaatatttgctttcttagattttgaagtaaacactttaacagtggatgttttcaagggaatgagttctaaaaattctgatggcaatgtgttgagttt

SEQ ID NO: 332392 - DNA, 4350 bp, Homo sapiens
ggtccaggcggcgcgcacggtatggcggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatggtaggtaatttctggtacaatgtaacaaatgagattttttgaaatatgattgtaattttgaagctataaaaataatatattgaacaagttgtttctctcatgtaaactatgaaatgattagaaatttttataattataaattattgtcgaatacatttctaaaagtatatgctgtaacagtatgtatttttaaattttcaatttgtaacttgtaaaccctccttaatgttatgactttgttaaataaagggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggttagtagaaacctgctttcaaaatgtttaaaaagctatatttggcaatattgactagggtaaacaaagaaagagatagtggtagaattgggggctgattagcattttctgtttcattattctctttcattgtcagatggtgttagatgcctatgggtaggtgtgggtagggccaggcagaaaattgactaccatatttcaccctcgtttttttttcagtgattatttccatatcactgaaattttacttttattccacttatttcagtaaactttcactggtactttagtaa

SEQ ID NO: 332393 - DNA, 218 bp, Homo sapiens
gtagatttacaatgcttttttaagtgatatattcctgtgtaaaggaactaaatatatatgctgtgtgaaaactaatcattagatggacatggcaaaaatagtcattctgaatggtgaaagtttcttttatttttcattcagacagtgcatgctgcccctttctaatctaagaaactttgttctcttccccttggtagaatttgcggaggatgactcca

SEQ ID NO: 332394 - DNA, 296 bp, Homo sapiens
actgcaggcacacagtttggaagggctctgcctttgctgctcttcatagaggaagacctcctgaaatgccagtgaattatggttccccaccaaatcttggtaagtaaggttggcctttgagatgcctgaaataattgtttttaaatttctcaacaacctttataaatgctgtattaaaatttaaaaggaaatactggttgaaatgttgttttaatagtaataagtatcaaatgtcaaattattgttaaaataattactaaaaataaaattaataaaaaatctttttatagtaagaa

SEQ ID NO: 332395 - DNA, 498 bp, Homo sapiens
catatttcccttttgtaggtaatatattttcgacagggtcatgaagcttatattgaggctgtaagaagaaataatatttatgaactgaaccctaataaggagccatggagaaaaatggatcttagggtaggatgatggcattattaaatcattaaacattttagcacatacatagttaaattacttacaaatctatttaaaaacctgttggaaacatattttattactttctttcctacttgataacatttctgctgtaaccaaaccttaagatcctgtgggaatggcttgtttgtcaatgggcaaaatttgtatgttgctgattggtgtgtaaaatgttaaatgcaacaacctagagtttcagaaaggcagcttggcaatatatatattatcactcttaaaaatgtttatgtatccaagacagattttcagaggaagaaatgcaagttttcaaaagaagaaataaaaactggaagaagggtttaacctcatggataa

SEQ ID NO: 332396 - DNA, 436 bp, Homo sapiens
cttcaggttttgccctcacctgtttctagacagtctgttctgggtcagctgtgatgaactcactgtagggttgataagataggcacatgggttggatttctttatttttgtattgatgagagattgtatacattgtatagccagccatctaaataagtttacatgttgtgtatttttttgttagggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatggtaggtaatttctggtacaatgtaacaaatgagattttttgaaatatgattgtaattttgaagctataaaaataatatattgaacaagttgtttctctcat

SEQ ID NO: 332397 - DNA, 601 bp, Homo sapiens
ttttgaaatatgattgtaattttgaagctataaaaataatatattgaacaagttgtttctctcatgtaaactatgaaatgattagaaatttttataattataaattattgtcgaatacatttctaaaagtatatgctgtaacagtatgtatttttaaattttcaatttgtaacttgtaaaccctccttaatgttatgactttgttaaataaagggacatgctgatgaagtatttgttctggagacacatccctttgattccagaattatgttatctgcaggacatgatggcagcatatttatatgggatattacaaaaggtaccaagatgaaacattattttaatatggtaagtgaagtgagatgtaccttgatacatgcttgataatttgtttagagtatttgggttatgcggcttagccagaaattgatctgcttgttttggcagtttgtttttacaaatcagcatattcaaagcctgctaaatattagacagctacatgtatatacgtacatacatgaaattctctgtatgactgatttatatgagggagacatttttaagttacctgttgagcattttatgtgcctgtgtgtttaaa

SEQ ID NO: 332398 - DNA, 427 bp, Homo sapiens
cgtggttaagaggattgcttgaggccaggcatttgcgactagcccgggcaacatagcaagaccttgtctgtacagaaaataaattttaaaaagatttttctcacaaagttttttcagtagatactatcttctcttagttctttatttttggtgcgcatcttaggtgaacgtgtgcttgttacatgctaaatgtatattagtttaaaagtgtattggaatcacttccccatcatattttcctaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttag

SEQ ID NO: 332399 - DNA, 8659 bp, Homo sapiens
ggtccaggcggcgcgcacggtatggcggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaagaaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaaccatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaaccattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaagaatttgttcctagagacagagaacccaatacaaaagtgagaacatgtatgcataatcagaaggatgcagtgcagatgcctagtgaaactctgaaagcaaaaatggtacctgagaaagttccccgcagatgtgctactgttgctgcaaataaaataaagataatgagtaatctaaaagaaacgatctcaggaccagaaaatgtctggattaggaagagtagcagaaaactgccccatcgaaatgcttctgctgcggctaagaaaaaattactgaatgtttataaagaggatgatacaaccataaattctgaaagtgaaaaagagctagaagatattaatagaaaaatgctttttttaagggggttcagatcctggaaagaaaatgcacaatagtgactatgagaatgtagaagtggcatctgaaaacaattggtacacaagtaaactggcagttacattctgctcccagctctaaaattactcccttattggcatctttggaggaattttctaaaagccataatccagtgggttcctcccagtcagctcttgtacagacatgtgctctggggaattctgaggaggaaataaattgcagagtctgtaggtggagaggtggaaagaaaagacaaatggcctgctataagactactattcctttccagaatgcaaggccttgaagacatgattccttagaggaagaatataatgggaagtgtacaggctaggaagaacttgaagtgaacaaatttcaaaatcttaacctgatgctaattttcagggttctccattacagtgtaaaaattcagaccacgacaactatggtgtcatgaggaaaaaaaatcaggcatttttccaaaggaagtgctaatgggcctatttgacttctgagtgaagcaaaaactacccagatccattccctacaattcacatccccaaaggtcaaaaacaaactaggaggacctgggaatttcagctggagatactgattattgagttctgaagtagagtgttggaaataggcaattagagaaagtccattgatgtcattttgtttataatattgcagttcatactgaatgaccacttgatatgactaattcagggaatatatatttttctatgaaagctatgaatgttactatcacggcttttccttatttttacttgtatgtagcagcatttacagaaatgccaaaaatgtgcctcattaagaggcaggtcttaatcagttagataaaaataaaatgtatagcttaagatcaaaacagtcatatttttagatacagtgaaatcttttatgtttctctacagcaccttaaaaattagaacttgaatactttgagtaaacttactacaatctcatcccaacaaactttaatggtagcatgtttggcctatttcattgtggcctgtactaggattagaaaatttggtcgtggtataacaaagaagtgtatttacaataggatttaatttgttgttaatatgtatttgttgaaattaaaattgccagattaaatgaatatactgtcgcatctttttaacatagtaacgtgttactggaaaaattaagttgttgaaagtaagttgttttcccatttaaaaatatctgaatatatgatttgcatgtgtaaatctgaaaaactaaactacagaaacctagggttttctatttcttttttaagtcaaatgcatttttttttttgttatacagatgaaccaagtgtctaaaatacttgagaaatttgtggttgcatgtctgttttaaaaaaaaggctttttgttttttagcataagccagaatattctaacctactaagtctgtgtcctttgctccttttgtagtatactttcatctaaattactgatccccaatatgttgatacacaggtgagaaagggaagaattcctaataaactgctattacttttaggtgc

SEQ ID NO: 332400 - DNA, 9402 bp, Homo sapiens
ggtccaggcggcgcgcacggtatggcggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaagaaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaaccatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaaccattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaaggtaaaacttttacagctaacatatctaaaactgtgagacgtcaaagacaaagcaaacgccctaggttaagtgtggatgataatgactgggaggatttggactatgcaaaatctaaaagagttcttcgacgttcaaaaataaaaacgagaaatcagggtagaaggactgtgagataccatgatggggatgatgacagaagtttagaaaatgtgttagatttcaatggttgcaccttatgaccttgagggaaagccagttcatttaagaggaaatggactggcatttatggtgaaagctggctgttaaaattatttttttgtcttacaattcagggaatatatttatatttttctatgaaaagttatgaatgtgactaaatcatgactgttatttttatttgcacttgctggtctttgtagcagcattcagcacaggtgccaaaatatgcttcattttgggggcagatctattttgacagtatttgactacatatagcaagagtttgaaatatgttaaacactagacatcctggttatcaaaaccaatgagcattactttcatggcagcaagtgtcatgcagttattttctgaatttgtcaaagaggcagtagtttctaacccctgttctatagtagttacaacaatttcacaacctatgtttacagattcttcataaatacatgcatactgacactataatcatgggaggtgtaaccatgattagtaggcgaggtacctaccacttttttttttttcttcccctggctacttgagtagaatgcattataccagatctggtcactttcattgaaatggtttctaattttcttcccaagtgctgttgggtttttttcttcttaaggaaaacgttgtcacttttatgttataaacttgaatttataaagtgctggtaaattatttttaatgatttgagtgcatgttttaaacctctaggaccagagcatagtcagagcattttcttttaaattgtgcactaacaaaatgctatataatctgtcttctgtccaagatctcctggtttccattgtaagggatttaaccaaaatcttgctcttccataatcttactctgtgaaatagaggaattcgtgtgccttagatttagaagtgtgttctttaatagagtgtacagggctaaaagagtatttaagttaatatgtaggtttcccccatctgtattccaattgtagaggtgagttttgttaagagtacaattgcaaatcttatctatataggaaaatagctaaatgtcattctccatctctttgttttagtttactgcttccatgtgcaatcctaagcattctttgctggggcaactaaatgtatctttattagtgacttctagtccaaatataagaaactgtcatgttttgtgggaaaataattttataatccatttaaagtgaaagtttatcacacaaatagtacacttattttctaaccaaatacttgataggttatgctactccagtgtagatggccattcctaacttgtttgtgcctgaagatggacttgattcaaatggtttacatatttagtgggtaagggatatgttacagtaccccacctgtaagttatttattagccctaattgtgtttgatttcagacaaaattaacccttttctcctgtgtatctttgaagtggcagataaggtgaagcatcagactggtatcaatattagacaatgttatttattagccctaattgtgtttggtttcagacaaaaccttttctcctgtgtatctttgaagtggcagacaaggcgaacatcagactggtattaatgttagagaatgttctgaagtgttcctattttgtagttatctattccatttgacatagtagaaggtacattttctttctactctgatgcatggggaaggatgtttttggacattatcaactgagataggtgggaaacctcctctcatttgtggcttagagagctatcaccatttcagaactatgatgcttttcttctcagaacttgtgttaagtagatagtaaacagattgattcatgataattgtccttgactaagactgaaaagactaatgggatgccttttactttgctaattttaaaaactggtgatagatgtcaaatccattaatttatttaaactcttcttaaccttctcttttataatctgttctcaggttttaactccatgtttaccatcatttgcaaaaaggtaccaaaaaaatccataaataaatatggaatacattcataagtacatacattcttttggtataaaacaatattttgacagtttaggcttcattaatagaactattctgattatttggactgcattaattggtcactgactggccatccaattaccattttttctttcagtccaaaatagttagacccttgcatacagaagtggtattttggtttttaatcagatttggtttcatcagaagcagcaagaatggacctgatgtctttaaaagcatagccgacaatggtagcttctcaagttatgaaataaaactgagagataatggagaaaataatttttatgggtttttttggttatggtgctattcctaaggttaactttgaatatgtgacacacacactcctaagtacctttaaggaaaattaataaatcattaatagttaaaatgtttacattgagcac

SEQ ID NO: 332401 - DNA, 2449 bp, Homo sapiens
ggtccaggcggcgcgcacggtatggcggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaattgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctagccatgtcaccctgtggcactaatcaggacactgtttatattcttcctcttctgtgtccctattcactttgtaattattctattttagctggttatatggtagttaattggtagcctgttttcctttgttttctttacttgtgtcaagctccatgtcgttgttttgtgatgagcagtgatttagaactggccagaccttagaagagtcttcagcaagctgccctagggtaggggcatattctctgtttgttttgtactggtaccccaggaggatgccttgtaactgctctttggtcatgatagtggtaatgaatccattcatgtaaaatgcaatatgtctgttagtttggggcacccgaggctcagtagaggtttagtatgatgccttccctttcttctttgagttatgaagaaactaatttctggcacagtgtgactgcttcaaacctatgttctgctgctatctcctatagaggagggcagacttttttttcttagtgcatttgctggtaggtcaaggagggatggactttgaattagtgttcagagtcacagatcctacgtatgtgctcttcagtagaggattttctgtgatcctacaatgaagggaaagctatataatttattggtacttcctaaagatagagactaaagtcatggtagtattggccaaattaattttaaaactgaacaagtcatgaattttcatataaatcaaagaactttttccttataaaagcttccatttttgaaaagttggatcagttgtaagacctttcatctttagtattgtatgatataattctacattgaaaaataaacacttggcattaaatgggacttggagtcaaaagatctggttttatggtccatctttaccaatcatttgctgtggatctctttaaaggtcctggaacctttgagcctcagttacctcacttgtaaattggcaaaaatacctacctcacagggttgttgtgaggattcaatgagctaatgtatgttgaaagcactttgtgaattgtaaagtgctacacaaatgttagttgttgttgctgctgtatctgagatgtcttaattttctttttcttcagaaatagtctaataaacctccagggcttttctgttaaagta

SEQ ID NO: 332402 - DNA, 2154 bp, Homo sapiens
ggtccaggcggcgcgcacggtatggcggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaattgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctagccatgtcaccctgtggcactaatcaggacactgtttatattcttcctcttctgtgtccctattcactttgtaattattctattttagctggttatatggtagttaattggtagcctgttttcctttgttttctttacttgtgtcaagctccatgtcgttgttttgtgatgagcagtgatttagaactggccagaccttagaagagtcttcagcaagctgccctagggtaggggcatattctctgtttgttttgtactggtaccccaggaggatgccttgtaactgctctttggtcatgatagtggtaatgaatccattcatgtaaaatgcaatatgtctgttagtttggggcacccgaggctcagtagaggtttagtatgatgccttccctttcttctttgagttatgaagaaactaatttctggcacagtgtgactgcttcaaacctatgttctgctgctatctcctatagaggagggcagacttttttttcttagtgcatttgctggtaggtcaaggagggatggactttgaattagtgttcagagtcacagatcctacgtatgtgctcttcagtagaggattttctgtgatcctacaatgaagggaaagctatataatttattggtacttcctaaagatagagactaaagtcatggtagtattggccaaattaattttaaaactgaacaagtcatgaattttcatataaatcaaagaactttttccttataaaagcttccatttttgaaaagttggatcagttgtaagacctttcatctttagtattgtatgatataattctacattgaaaaataaacacttggcattaaatggg

SEQ ID NO: 332403 - DNA, 1398 bp, Homo sapiens
ggtccaggcggcgcgcacggtatggcggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtaagaacttcttcacatttttttcttagttttttttttttaaacatctattaaatgaccacttggttgctaagaacttttattagctacatggtaaatgacttctggtgtttatttcattaggttcaatttatgatgtttattttgttagccttgttcttccagtcctccagtctgcctttctctgatttctggtagtaatcagtgatataagagatggctggtaaaagggaggcttgaggtgtc

SEQ ID NO: 332404 - DNA, 577 bp, Homo sapiens
ccgggcatggtggtgtgagcctgtagtcccagctacttgggaagctgaggcataagaatcgcttgaacatgggaggcgtaggttgcagtgagcggaagattgcacaactgcactcctgactggcaaaagagcaagtctatctcaaaaaaaaaacaaaaacagactaagcaatagcttcatgttgttatagttcaggtcacactgtgccaccaaatgagttcaggtcatataaggttttgccactaaattatttgtgaaaaggaaaaaaaaacctgtagttttcaagagtatttggtatttctaaattgttaagagactgacctgtaatacacatgaggaggactgcctggcacaaaggcaggataggccaggcgcagtggctcatgcccataatcccagcactttgggaggctgaggtgggcagatcacttgaggccaggagttcaagaccagcctgggctacatggcaggtatccatctctacaaaaaaaaaaattaaaaaattacccaggtgtggtggcatttgcctgcaatcccagtgctttgggaggtcgaggcaggaagatcactcgagccc

SEQ ID NO: 332405 - DNA, 6786 bp, Homo sapiens
cccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcacagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatcctggagctcagtggccctgcccatatgacctacattttggatatgttcatgcagctggaagaaaagcatgagtgggagaagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtctcagcagaagtggaaagattttgaacttccaggagacactctgtattaccgcttcacctccgacatgagcaacaccgagtggggctacagattcaccgtgacggccggacacctggggcggttccagacaggattcgagattttgaagcagatgttgtcagaagaaagggtcgtgcctcatctcccattggcaaaaatttgggaatggctggtgggcgtggcctgtcgccagactggccatcaacgattaaaagccatccacttacttctgaggattgtgcgatgctgcggccacagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggagcttggcgtgctgcaggattacctgctggccctaaccacggacgaccaccttctccgctgtgcggcacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 332406 - DNA, 6656 bp, Homo sapiens
cccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcacagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatcctggagctcagtggccctgcccatatgacctacattttggatatgttcatgcagctggaagaaaagcatgagtgggagaagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtctcagcagaagtggaaagattttgaacttccaggagacactctgtattaccgcttcacctccgacatgagcaacaccgagtggggctacagattcaccgtgacggccggacacctggggcggttccagacaggattcgagattttgaagcagatgttgtcagaagaaagggtcgtgcctcatctcccattggcaaaaatttgggaatggctggtgggcgtggcctgtcgccagactggccatcaacgattaaaagccatccacttacttctgaggattgtgcgatgctgcggccacagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggagcttggcgtgctgcaggattacctgctggccctaaccacggacgaccaccttctccgctgtgcggcacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 332407 - DNA, 6847 bp, Homo sapiens
gtagaaaagacagtgaggctggtgccaaagtcatcaatgaagggaggcagaggggtgagcgtgattgtgtggagaggatcaaatgaggtcatttgtgaaaaatacttaacacagtatctggcacccaagtagtggtgggagggatgggtttatattcacaaagaagataaataatctcatctccatgcttctgggtaactctcttgagcccgtcagagggactcacttgctgttttgtgtgttaccttctataggtattatatttgtatttacttaagttcctgtgccgctttgctcagctgactgccacttgctctttttcatgtaagaaatcattattattattaagaaaaagatgttctggcaattaagtgaatcagtgatttcctctgtttctagttattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcacagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatcctggagctcagtggccctgcccatatgacctacattttggatatgttcatgcagctggaagaaaagcatgagtgggagaagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtctcagcagaagtggaaagattttgaacttccaggagacactctgtattaccgcttcacctccgacatgagcaacaccgagtggggctacagattcaccgtgacggccggacacctggggcggttccagacaggattcgagattttgaagcagatgttgtcagaagaaagggtcgtgcctcatctcccattggcaaaaatttgggaatggctggtgggcgtggcctgtcgccagactggccatcaacgattaaaagccatccacttacttctgaggattgtgcgatgctgcggccacagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggagcttggcgtgctgcaggattacctgctggccctaaccacggacgaccaccttctccgctgtgcggcacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 332408 - DNA, 7435 bp, Homo sapiens
cccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcacagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatcctggagctcagtggccctgcccatatgacctacattttggatatgttcatgcagctggaagaaaagcatgagtgggagaagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtctcagcagaagtggaaagattttgaacttccaggagacactctgtattaccgcttcacctccgacatgagcaacaccgagtggggctacagattcaccgtgacggccggacacctggggcggttccagacaggattcgagattttgaagcagatgttgtcagaagaaagggtcgtgcctcatctcccattggcaaaaatttgggaatggctggtgggcgtggcctgtcgccagactggccatcaacgattaaaagccatccacttacttctgaggattgtgcgatgctgcggccacagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggtgaggcctgaggtctgggcagggagcccggtgcctccatgtgcgtttgctccctctgctacccagggcagaagctgctgcctcatccgagcctgagtggccagggtctcgacaggccacacaggacaggcatggctgagagtctgaggctctcgcctctcccaggcctgggaaaccctcaggtcagctctgagattgcttattttgtcaggcctagagccaatgggggagaaactgcccgggatcagcccttgacaacagtgagttttggaaaataaaacgatgggttatttctgcttccttctctttttttcctcccctcagcacaatagactgattgaatgtgggagctgaaagggcctttcagagttctttagcttccctctcctttcacacatgaggaaactggcttgaggaggggtcccggcctggtcacccaagggcaggtggaggcaaaggtgaccccggcaccgggcacctggctcccgccagggttctgagcaaggcagtgccacgcggtgctgggcggcgtgagtagcgtccgcccatgagaggcttctgctttcgcaagcaggtgtcccaggtggtctgggagagctgcactgcgcatctggcgctgtcactcacagcccctgctctctctctgcaggagcttggcgtgctgcaggattacctgctggccctaaccacggacgaccaccttctccgctgtgcggcacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 332409 - DNA, 5539 bp, Homo sapiens
gaaaagcattattctggtagtttttaagctagttaatgaatggctctttgaaggcttctgggtctgccttggagtgtagtgagctctaacgagttgagtttggagccctgtgtactgcccctaatggagctcttgccttccagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatcctggagctcagtggccctgcccatatgacctacattttggatatgttcatgcagctggaagaaaagcatgagtgggagaagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtctcagcagaagtggaaagattttgaacttccaggagacactctgtattaccgcttcacctccgacatgagcaacaccgagtggggctacagattcaccgtgacggccggacacctggggcggttccagacaggattcgagattttgaagcagatgttgtcagaagaaagggtcgtgcctcatctcccattggcaaaaatttgggaatggctggtgggcgtggcctgtcgccagactggccatcaacgattaaaagccatccacttacttctgaggattgtgcgatgctgcggccacagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggtgaggcctgaggtctgggcagggagcccggtgcctccatgtgcgtttgctccctctgctacccagggcagaagctgctgcctcatccgagcctgagtggccagggtctcgacaggccacacaggacaggcatggctgagagtctgaggctctcgcctctcccaggcctgggaaaccctcaggtcagctctgagattgcttattttgtcaggcctagagccaatgggggagaaactgcccgggatcagcccttgacaacagtgagttttggaaaataaaacgatgggttatttctgcttccttctctttttttcctcccctcagcacaatagactgattgaatgtgggagctgaaagggcctttcagagttctttagcttccctctcctttcacacatgaggaaactggcttgaggaggggtcccggcctggtcacccaagggcaggtggaggcaaaggtgaccccggcaccgggcacctggctcccgccagggttctgagcaaggcagtgccacgcggtgctgggcggcgtgagtagcgtccgcccatgagaggcttctgctttcgcaagcaggtgtcccaggtggtctgggagagctgcactgcgcatctggcgctgtcactcacagcccctgctctctctctgcaggagcttggcgtgctgcaggattacctgctggccctaaccacggacgaccaccttctccgctgtgcggcacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 332410 - DNA, 3425 bp, Homo sapiens
cccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcacagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaagtaagagacgagagggactcctgctcctctttcctggtgcagatgtgctggcctaggagttagaagcatcaccgagttccagctgcttctgccctgtgcacactcctttagtacagtgttgaaaactcccttgcttctgtattccctgttggaaatagggattatgacacctgtctacccctgtcagggaaaatgaatttaatgtttgttcaaagaacagtggaagagaagcattttatggaaacacatgattaaccattatatcatggtaataaagtatacccttgaattcatatttccctttaaagttgctttcagccaaaatcagtctctaaatttgtcctcacttatgtttatttgtacgtaggattttagttgatcattataattttattactgttccccgtagaccttagagttttcttagcggaactactgtggttccctgtggactttctgtgcccagtgccaactttcggcccaggaaaggctgccatcatgtaggagggagtgagcggccattcaggcccaggaaaggtgccgccacataggagggagtgagcggccattcacagcccagcagaggctggaacctgcagaaacagctctcaattgccagaagaggatttggttaggtttaaggaaaatgtgctacaacatattaatggataatttggagagtatttgaacttttattcttagagaatattttaaattaaaattttttattattagaactatattgcagaaaactttat

SEQ ID NO: 332411 - DNA, 5564 bp, Homo sapiens
cccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcacagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatcctggagctcagtggccctgcccatatgacctacattttggatatgttcatgcagctggaagaaaagcatgagtgggagaagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtctcagcagaagtggaaagattttgaacttccaggagacactctgtattaccgcttcacctccgacatgagcaacaccgagtggggctacagattcaccgtgacggccggacacctggggcggttccagacaggattcgagattttgaagcagatgttgtcagaagaaagggtcgtgcctcatctcccattggcaaaaatttgggaatggctggtgggcgtggcctgtcgccagactggccatcaacgattaaaagccatccacttacttctgaggattgtgcgatgctgcggccacagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggtgaggcctgaggtctgggcagggagcccggtgcctccatgtgcgtttgctccctctgctacccagggcagaagctgctgcctcatccgagcctgagtggccagggtctcgacaggccacacaggacaggcatggctgagagtctgaggctctcgcctctcccaggcctgggaaaccctcaggtcagctctgagattgcttattttgtcaggcctagagccaatgggggagaaactgcccgggatcagcccttgacaacagtgagttttggaaaataaaacgatgggttatttctgcttccttctctttttttcctcccctcagcacaatagactgattgaatgtgggagctgaaagggcctttcagagttctttagcttccctctcctttcacacatgaggaaactggcttgaggaggggtcccggcctggtcacccaagggcaggtggaggcaaaggtgaccccggcaccgggcacctggctcccgccagggttctgagcaaggcagtgccacgcggtgctgggcggcgtgagtagcgtccgcccatgagaggcttctgctttcgcaagcaggtgtcccaggtggtctgggagagctgcactgcgcatctggcgctgtcactcacagcccctgctctctctctgcaggagcttggcgtgctgcaggattacctgctggccctaaccacggacgaccaccttctccgctgtgcggcacaggtactctctccaccccaacagagctggcccccaggctggggcgccaccatctcaccattgccagggcagagaaggtctgtacattgcgtctgagtaggacagaatccacccggagcttacacagagcttgttccagttcagtcacttcctcctggtgctcagagagcatgcacgagccccatttatcagagtcattcactctaaactgtggggtcagaagaatttgtgtctttaaaaccaaaacaaccgatgccttaaatttagtttggctgattcttgaagtttccgtggagttagatttcacatatttttagatgtgagttgcttctctggtagcggaactcctcttctgacagctgtttggtctcaggacgcttcacacttttcactgactgaggagctcagaaagcttttggatatgtctattatgcatatatccatatgtgccattagaaacgagattttcaatttaaaaattaagcaaaagtgtaaacctttatcaatttatttttttaaagtagtgaacccatttcatgttaacatgaataacacgtcttgtgaaaaacgactctaacttttcaaaacaaagtaattactgagtgctctgggacaaataggtgaccaaaaaagaaaaaaggaatgcctgcagagggtg

SEQ ID NO: 332412 - DNA, 484 bp, Homo sapiens
acctccaccctcttgctgcccagaccctgaaggcctgacgggcctggcctcgcctccagggcatctcagtgccctcctggccctgttttctctactccctctggtccccagcactggctgttcgtttcctgtgagtgccttgcccttccccacctgcatctttgcactgttttccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 332413 - DNA, 597 bp, Homo sapiens
  misc_feature (92)..(92): n is a, c, g, or t
gagatcagcctgcccaacatggagaaaccccgtctctactaaaaatacaaaaattagctgggtgtggtggtgggtgcctgtaatcccagctnacttgggaggctaaggcatgagaatcgcttgaacctgggaggcggaggttgcagtgagctgagactgcgccactgcactccagcctgagcgacagaacgagactccatctcaaataaataaatacataaataaagcaaattccaggccttaaattatttccttcctacatactttatacccccctttaaaaattatgggttttattcacattaccaaaatgctattaccacaccttccaaaatcacaataagcaattcttccttagtccaatttctgcagacaacctctggggattgtgaaaccctgaaaggcatgttctgtgtttgtgtttcttcatttttctggagagagggcccacacctttctttacattttcagtaagcgcatcctagaggtgactaatgcccagttgcgaccacatgctctcctaaggccctgtgctcctgtttggagccacaaaagcttttggagggttgtaagctttaaatgtgtcttgcctttgca

SEQ ID NO: 332414 - DNA, 181 bp, Homo sapiens
acttaaaccaattctgtgccagcctgtggcagactctttggacttagagatgagaagatccctatccttgcgtgcttgttgaaatcagaggcacaatcaaagggggctgggcttatgcctaagaattctttcttgtctccatgtttgagttgcctttctgtctctgtctaccacgttctag

SEQ ID NO: 332415 - DNA, 383 bp, Homo sapiens
tgtttctaatacctcacaatagtgtttcctctttgatatatggcatcagggctttggcggggatattttccgtctgccccagctcaagagttttctgggtgttcctgacttgcattgtgtctccagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaagtaagtacaaaggacaggtccagaaggaaaacagcaaagatcattgtaaataaatcctgattatcttctctgattaatagcagcatcatttc

SEQ ID NO: 332416 - DNA, 6192 bp, Homo sapiens
gcattatgtcaaagatgatagggagtatgagtgaagcacttgtggaagaacgggattcgatggacagaaaggtgaatccaggaaagataaaatttttcagaagttgaaaactcagataggccttgaaccagaacagattcttagaagcagaggacaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcacagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatcctggagctcagtggccctgcccatatgacctacattttggatatgttcatgcagctggaagaaaagcatgagtgggagaagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtctcagcagaagtggaaagattttgaacttccaggagacactctgtattaccgcttcacctccgacatgagcaacaccgagtggggctacagattcaccgtgacggccggacacctggggcggttccagacaggattcgagattttgaagcagatgttgtcagaagaaagggtcgtgcctcatctcccattggcaaaaatttgggaatggctggtgggcgtggcctgtcgccagactggccatcaacgattaaaagccatccacttacttctgaggattgtgcgatgctgcggccacagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggagcttggcgtgctgcaggattacctgctggccctaaccacggacgaccaccttctccgctgtgcggcacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 332417 - DNA, 3851 bp, Homo sapiens
ttgtttgttttttggggttttgtttgtttgtttgtttttaattttttgtagagacagggtctcgctttatttcccaggttggtctccaactcctgggctgaagtgatcctcccacctctgcttcccaaagtgctgggattacaggtgtgagccaccatgtgtagcccgtaacatccatttttcaagatgcacagtaatccccgtgagcacatttccgacctcctgttcccttggagcctggttttaaagtttaggttctgcccctttccttctttgctgttggtgactattcgtggctgctttgtggggagcataggtgaggcgactttataatcatttgtaccagctgtgggagagggagggtctgagctgtggttcctgccagctgtaagccatgtgaccttggcatggctctcagtaaactgaccacctccggggctcctcctgcagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggtgaggcctgaggtctgggcagggagcccggtgcctccatgtgcgtttgctccctctgctacccagggcagaagctgctgcctcatccgagcctgagtggccagggtctcgacaggccacacaggacaggcatggctgagagtctgaggctctcgcctctcccaggcctgggaaaccctcaggtcagctctgagattgcttattttgtcaggcctagagccaatgggggagaaactgcccgggatcagcccttgacaacagtgagttttggaaaataaaacgatgggttatttctgcttccttctctttttttcctcccctcagcacaatagactgattgaatgtgggagctgaaagggcctttcagagttctttagcttccctctcctttcacacatgaggaaactggcttgaggaggggtcccggcctggtcacccaagggcaggtggaggcaaaggtgaccccggcaccgggcacctggctcccgccagggttctgagcaaggcagtgccacgcggtgctgggcggcgtgagtagcgtccgcccatgagaggcttctgctttcgcaagcaggtgtcccaggtggtctgggagagctgcactgcgcatctggcgctgtcactcacagcccctgctctctctctgcaggagcttggcgtgctgcaggattacctgctggccctaaccacggacgaccaccttctccgctgtgcggcacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 332418 - DNA, 7402 bp, Homo sapiens
cccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcacagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatcctggagctcagtggccctgcccatatgacctacattttggatatgttcatgcagctggaagaaaagcatgagtgggagaagatcctgcagaaagtgctccagggctgccgagaggacatgctggggaccatggccctggctgcatgccagttcatggaggagccaggaatggaggtgcaagtgagggagtcgaaacacccgtataacaacaacaccaacttcgaggataaagttcacattcctggtgccatctacctctcaatcaaattcgactctcagtgcaacacagaggagggctgtgacgagttagccatgtccagcagcagtgacttccagcaagaccgacacagcttcagcgggtctcagcagaagtggaaagattttgaacttccaggagacactctgtattaccgcttcacctccgacatgagcaacaccgagtggggctacagattcaccgtgacggccggacacctggggcggttccagacaggattcgagattttgaagcagatgttgtcagaagaaagggtcgtgcctcatctcccattggcaaaaatttgggaatggctggtgggcgtggcctgtcgccagactggccatcaacgattaaaagccatccacttacttctgaggattgtgcgatgctgcggccacagtgacctgtgtgaccttgcgctgttgaagcccctgtggcagctctttacccacatggagtacggcctgtttgaggacgtgacgcagcccggcatcctccttcccctgcatcgtgccctcactgagctcttcttcgtcaccgagaaccgtgcccaggtgaggcctgaggtctgggcagggagcccggtgcctccatgtgcgtttgctccctctgctacccagggcagaagctgctgcctcatccgagcctgagtggccagggtctcgacaggccacacaggacaggcatggctgagagtctgaggctctcgcctctcccaggcctgggaaaccctcaggtcagctctgagattgcttattttgtcaggcctagagccaatgggggagaaactgcccgggatcagcccttgacaacagtgagttttggaaaataaaacgatgggttatttctgcttccttctctttttttcctcccctcagcacaatagactgattgaatgtgggagctgaaagggcctttcagagttctttagcttccctctcctttcacacatgaggaaactggcttgaggaggggtcccggcctggtcacccaagggcaggtggaggcaaaggtgaccccggcaccgggcacctggctcccgccagggttctgagcaaggcagtgccacgcggtgctgggcggcgtgagtagcgtccgcccatgagaggcttctgctttcgcaagcaggtgtcccaggtggtctgggagagctgcactgcgcatctggcgctgtcactcacagcccctgctctctctctgcaggagcttggcgtgctgcaggattacctgctggccctaaccacggacgaccaccttctccgctgtgcggcacaggctctgcagaacattgctgccatcagcctggccatcaactacccaaacaaggccacccgcctctggaatgtggagtgttagcccttggtggggcgtgcatgggactagttcatctgccacagggattttagagcagacatctaacctcattcaggaaaactcctgtagcgccagtgcccagctctccttgagctgaccactccagttaggatgccaagcagccacgtctccaagagctcccgtgcgtaggctggacacaagcacaggctgtagcatggtgaaaataagccaagcagtgcagaatgcctcagaaagggtgggcagggggcccttaagaaggttcagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggccgcaccctcccagagaactccttgaggagaacaagtgcccttggggacagccggcaggcgcccctgtacgtctgctcatgcaccaggcagcacagccgcagttcctcagttgttgttttgacatatttcagtttccacctcacgtttttagagcagaaccacactgtctccctggaggggctcgagggcatgaccggggactgaccattctgtgaaaggagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatccttgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggta

SEQ ID NO: 332419 - DNA, 3473 bp, Homo sapiens
cccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcacagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggctcacggttttgaggagatccgtgctactttccttcagaccgatttgctgaagttgctggtgaaaaagtgcagcaaagggactggctttagtaaaacgtggctcctccgggacctggaaattttgtccatcatgctgtactcctcaaaaaaggagatcaacgctttggctgagcacggagacctagagctggatgagcgaggggaccgagaggaagaggtggaacggccagtcagcagccctggcgacccagagcagaaaaagctggacccccttgagggcctggatgagcccaccagaatatgtttcttgatggctcatgatgccctcaatgcccctctgcacattctccgggccatatacgaactgcagatgaaaaagaccgattatttcttcctggaggttcagaagaggtttgatggtgatgagctcaccacagatgaaaggatacggtccctggctcagcggtggcagcccagtaagagtctgaggctggaagaacagagcgccaaagctgtggatacagacatgattatcctgccatgcttgtcccggcctgcacgctgtgaccaagccactgctgaatcgaaccctgtgacccagaagctgatctccagcacagagagcgaactgcagcagagctatgccaagcagcgccgtagcaagagcgccgccctcctgcacaaggagctgaactgcaagagtaagagggctgtccgggactacctcttccgagtgaacgaggccacagctgtcctgtacgcccgccacgtgcttgcatccctgctcgccgagtggcctagccacgtgccagtgagcgaggacatccagggccatggtccccagcatgtctctcggcagccctggagcactttctgcaggatcttctcccactcatgcttttcttccagctgcatgaacatatc

SEQ ID NO: 332420 - DNA, 2917 bp, Homo sapiens
cccttgtcaccttccacacccacccgccggcctcccttcacccgagggcgactccggctgctctcctttcgatccatggaggaggccagactggtgcccacagtgaaagagaaataccctgtgctgaaggacgtcatggacttcattaaggatcagtcgctctcgcacaggagtgttgtgaaggttctttccctgaggaaagcccaggcccagagcatcctggaagtcctgaagataactcagcactgtgcagaatcccttgggcagccccactgcttccatccacctttcatacttttcctgttggaacttctgacctgtcagaaagattttaccaattattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaatgcacatgttcattgctcgctactgtgacctgttaaatgtggacatctcttgtgatgggtgtgatgagattgccccctggcatcgataccgctgtctgcagtgcagcgacatggatctctgcaaaacttgcttcctaggtggggtgaagcctgagggccacggagacgaccatgaaatggtcaacatggagtttacctgtgaccactgccagggtttgatcataggccggaggatgaactgcaatgtttgcgatgactttgatctttgctacggatgctatgcagcgaagaaatactcctacggccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcacagcagtgccaccaccctgcggagccagtgcatgcagctcgtcggggactgtctgatgaaggctcatcagggaaaaggccttaaagctctagctttgctgggtgtattgccagatggggactcgagcctagaagatcaggccctaccagtcactgtgcccaccggagcgtcagaggagcagctagagaagaaagctgtccagggtgctgagctgtcagaagcaggcaatggaaagagagctgttcatgaggaaatcagacctgtagatttcaagcagagaaataaggcagataaaggtgtatcattatcgaaggatccttcatgccagacccaaatttcagattcacctgcagatgctagcccacctacaggacttccagatgctgaagattcagaagtgtcatctcagaagcccatagaggaaaaagcagttactccaagccctgagcaagtgtttgctgagtgttcccagaagaggattttgggattactagcagccatgttacctcccttaaagtcgggccccacggttcccctgatagacctggagcacgtccttccactcatgtttcaggttgtcatctcaaacgcaggccacctgaatgaaacctaccatctcaccctgggtcttctcggccagttaattatccgtcttttgccagcagaggtagacgccgcagtgatcaaagtcctctcagccaaacacaacctgtttgctgcaggggacagttccattgtgccagatggctggaaaaccacccacctgctctttagcctgggagctgtgtgtctggacagccgggtgggcttggactgggcgtgctccatggcagagatcctgcggtcactcaacagtgccccactgtggcgtgatgtcattgccaccttcacagaccactgcatcaagcagctgccattccagctgaagcacaccaacatcttcaccctgctcgtgctggttggcttcccccaggtcctctgtgtgggaacccgctgcgtttatatggataatgccaatgaaccccataatgtgatcatcttgaagcactttactgagaagaacagggctgtgattgttgatgtcaaaactcggaagaggaaaacagtgaaggactaccagctggtccagaagggaggaggacaagagtgtggtgactctcgggcccagctgagccagtactcccagcactttgcctttatcgccagtcaccttctgcaaagcagcatggacagccattgtcccgaggcagtagaagcaacttgggtcctgtccctggccctgaaaggattgtataaaacactaaaggtaatggggagcttctccagttggcagtggatctggctataatttgacatctgcatggggattaactaggaggaaatgccatctgatttcgatggatggtaaaccataggatcttgattatttttagaaacgcgtgggccttacacacagataacttcaaagaggaaatacaattttcctgatggcttctctgtctttccattgtttcaaggaatctgatactactacttcatgggaacacaactttgtcagacgagaagaaaaattgaaaagtttcttactttcctctctaaatgacaattcctgtgcttcatcatagaagatgaagggaagaatagagggagctagcctcctaggggatgagcaacag

SEQ ID NO: 332421 - DNA, 966 bp, Homo sapiens
gtagaaaagacagtgaggctggtgccaaagtcatcaatgaagggaggcagaggggtgagcgtgattgtgtggagaggatcaaatgaggtcatttgtgaaaaatacttaacacagtatctggcacccaagtagtggtgggagggatgggtttatattcacaaagaagataaataatctcatctccatgcttctgggtaactctcttgagcccgtcagagggactcacttgctgttttgtgtgttaccttctataggtattatatttgtatttacttaagttcctgtgccgctttgctcagctgactgccacttgctctttttcatgtaagaaatcattattattattaagaaaaagatgttctggcaattaagtgaatcagtgatttcctctgtttctagttattttggacacctggaaggctgtggtgctgatctacacaaagaaattcgagacacttactatcaacttgttctgtttttggtcaaagcagttaaaggatttagtagcctaaatgacaggtccttgctccctgccttatcctgtgttcagacagccctgcttcatcttttggatatgggctgggaacccaatgatctcgccttctttgttgatattcagttaccagatctcctcatgaaaatgtcacaggagaatataagtgtccatgacagtgtgatcagccaatggagtgaagaagatgagcttgctgatgccaagcagaattcagaatggatggatgagtgtcaggatggcatgtttgaggcctggtatgaaaaaatagcccaggaagatccagagaagcagaggaaaggctgtctgaacacaggataaggcagggagcaaggacctgtcatttaggctactaaatcctttaactgctttgaccaaaaacagaacaagttgatagtaagtgtctcgaatttctttgtgtagatcagcaccacagcctttcaggtgtccaaaat

SEQ ID NO: 332422 - DNA, 2882 bp, Homo sapiens
  misc_feature (894)..(894): n is a, c, g, or t
  misc_feature (1136)..(1136): n is a, c, g, or t
  misc_feature (1324)..(1324): n is a, c, g, or t
  misc_feature (1387)..(1387): n is a, c, g, or t
  misc_feature (2320)..(2320): n is a, c, g, or t
aacgcagataaggcaactcttatggagcttacagtccagtgggcaagcgcataattgcaagaggtactaagtgctgtgaaggaaatagattgctctgttaaggaataggaagtgagaagtgatcaaatcggaaggagctgccatatatgaagcagggcatatgcagttctggcagagggaaaagtatgttcagagattgacgggactgctgaacggtactgttcaacagcatggcctggtggaagatacagaaggctggcgttgctggaggtagggagtgactcacagacagtgatgagatgagggtggtgagatcatgcaggaccttgggaaccaaggtgaggaagtaagagtttactttaaatgctttaggtagtaatcacaattttaaacagaagtgacatgatccctctgtaaatgtctgtggaaataaattgagttgaataccatttgaattttatctacagaaaagtatccagtgtattgcagcttttttcctgcaccatacagcccaattttgtcaagggtctagtctagtgataagctctgaagtttttggtattatttgctgaactggattgggttggattggattagtacactggaatcatgtagcatcagttgcctagtttgaattgagatgatctgataccctctccatttcagagtgatttattctgaaatggagtgaataaatgccacactgtgcgtcagaatgacctgtgcatcagaatggcctgtggcactttttaaacatacagatgcctgaggtacagatctcagtccaaaccgactggatcagaatctctagaacagtagttttcactctcgatgtgcattgaattcatctttcatgcatattccagattcttttatgtcatttagctcctaggncagtggagggacaggaatcaagaagagggtatggaaactgaatgcacaaaactggagggattcctatgtttacaaaagttaatttgggcatctcctgagcttggcagaaaaggatgaggatgatgtttctgtaaaatctgaaaatcaaacaaaggcaattttgtttactatagatggtttttaacacaccttagtcatggccttgacaaacctgatgtgatttaagattctgttgatagctnttgcccaagtgagatctttgaatacctactttcaattaatataacttgtaatttctctctggaaaggatagagtcctaatcttaggttcattctttttacaaattaattatgtagggtagaatttacaggattgcaacactgttgtgttagaaatctttatatagtaagaaagttatttgcttctaanattcgatgttttggggcagctgataacttgtgtagccatgactattgagtcagaactgttacnattcaggcaccctctataggtggactttccagtagttgctttaatgaaaacgtggtttttgtggcaatacttttttcctttaagtaaaaaattttaaaaaacaaaaataaaaagtctgtgtatttagtagcatacatcttacagatcttgggaaaaaaccccaagtccctttgtttatgactaaataactttcttcctatatgtagaaatgagtattgtcctgataataagcataggacaactccttgacttgagattaactccaatggcatatatggtctgtagatatttttgtgaaaaattacagttgtagatgtttcagggtttatttgtgaactcagtttcactactaacaaggcaattatactacttaacatgttaaacaggttttagaaaatagttttgtaattataagggtaataagtgaaaagtaagagaaacaaaaggcataaaacaaaacaatgaatattttaatctttatttttaaattgttttcttacttttttaaatactatcggtgaatctggttactgccagctgttgttatgtcagtcgaagacttagccagctatcaagtcatgatccgctgtggagaagacattgcaaaaaatactggctgatatctgagtgagtattcgaggaatatgtacttctgaaaactggcccttggcttcttccataacactagtttgtcctgattctcctctctaacccttgtctctttatctcctttggtggctcttctcgtgcctgctagtaaatgttggtatttgccaaggttctgtccttagcccactgctgctctcccttgctgaactctactgcatgcattgttgccgtttatagtgactatctgcatgctcctaactcccaaacctgaatctccctccctgacttccccactgaggtctagaattgtttgcacaactgtcngctggacctttctattggctgtcccacacttattaactggattcagtaaatgttaacaaatttgacagaatcaaagtacagatgacagaaagtgggagttgagaaaggtggaagaaatgagtaggaatgctgatatcttttcttagattaagtggagtcaggtagtgactaaagttggtgaagtaagaagcagaggtttaagcatattatttaaagctgcaagctttagacagaagtgaaaattaataacagagctatcaaaacattgggaggaaaaagaacagggtaaggggaattttaagtattgctagatcttcccgtgtttccctttggggtatcagtagatacatgtgaagttgataaatcaagaattagaggcataaacatttagaactatagaggtaacttctagaaatacctaagatttcctttgaggagttggacttaaaacaggagaatagtttttcatcgtaagttctttgatactttttagttttaataatctatgtgtatattatttagattaataaaaagatgctccccttccctcttctacccccgc

SEQ ID NO: 332423 - DNA, 2393 bp, Homo sapiens
aggggggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacatttt

SEQ ID NO: 332424 - DNA, 1656 bp, Homo sapiens
aggggggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggtaagttaaattttcctctagtgctgatttacatgactttgtagggttaacactgcagataagccaggcaaatagttagtttataaatagtgttccagagaaccctagagattttgagaaagtatcttgggggtcatgtgaatttgttgagagaaatggacaagtaaatgaggctccatagtctctaaccagagaatttctgctgttttaaagattcaacttgtttttcactgttcagtggcctaaatgtagattatgagaaataccacattagaccagtagaatcagctttaagactgggaaaacaacttcttacagtgtttttgctcaaacttccaatttaatgtcaaataaacaaatattccataaagatcattataaag

SEQ ID NO: 332425 - DNA, 779 bp, Homo sapiens
gtctttgtcctatcaacaagtgagagatgattgttgaaatctccaaatataattatagttttttgtttctctttttagttctgtcaggtttgcttcatgtattttgaagctgtataattatatgcaaatatgctaaggattattatgtatttttaatgacataattctttcatcattatgaaatctccatctttatcgctgataatattccttgtcctaaagttcaaagagcattgaggtgtgttttggcaggcagttgagttactattgggtcgacttgatcctttggaatcttgtttgtttttaatgtttgttagggtgggtgtaaagttgtctttatttaaggacggtggttgtcaactttcagtctcatgaccccctgaaactctaaaaacttattgaggactccgaagaattcttgcttatgtggattgtattaatgcttaccatatcagaaattaaaactgagaaataagtaaaacaatatttacttattagttccttttcaaatgacaataataaacccatttcatgttcagctctctcttaactatgttctttcttattagttttcgtttccttctaaccacaaataaacatataaaatcttaaacagacaccatcccacacaacaatttggcggttcgccctgaaaagtctttaaaacatcgttggcgcgggccccgtgaggaacgtgcctcgtcccgagaccggctgactggtggttccccaaaacggggcgggttgaaacaaggttggccgcacaggcgggcgttaag

SEQ ID NO: 332426 - DNA, 926 bp, Homo sapiens
gaattccttttttgactggcccagtatctgtatgagtttggaataatcttttccctaaatgtttgatatgattcatcactgaagttatctggggctagagttctgtttgtgggaaaattttgaaatttgaatttaatttctttaatattcatattttctatttcttcttgtttcagttttggtaatttgtgcctttcaaggaatttgtccattccatctaaatgttgaatttattggtataaagttattgacagtattcccttgatatccttttaatggctacaaaagccatagtcacttgtcctcttttgttcttaatattgttaatttatatcttctcttttgttcattgctttagttaggggtttgtaatttttattgatcatttaaaggagcaacttttggttttactaattttctctatttgcttattttctatcgcattgatttctgcagttatctttatttctttccttctactttgagtttgcttttcttctagcttttttaaggtagaagtttatattagtaattttagaacttttctctctccaagcactgttttagctgcatttcacaagttttgatgtgttttcatgaacgcgtagttcaaaatagtgtcagatttcccttgtaatttaattttgatctatgacttttctagaaatgtgttaattttcaaacatttgggggagttttcagttatcttttggctatcgattttttaaatttattgtggttagagaatttgctctgtattttcaatcctaaatgttttatggcccaaaattatggtttatcttggtaaatgatccttgtatatttgaaaataatgtacattctgctattttggggaatattactctataaatgataggtcaaatcggttgacagtttttttcaagtcttctgtatacttgctgatt

SEQ ID NO: 332427 - DNA, 2407 bp, Homo sapiens
aggggggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctggagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttccataaactaatattagtcagca

SEQ ID NO: 332428 - DNA, 4251 bp, Homo sapiens
  misc_feature (894)..(894): n is a, c, g, or t
  misc_feature (1136)..(1136): n is a, c, g, or t
  misc_feature (1324)..(1324): n is a, c, g, or t
  misc_feature (1387)..(1387): n is a, c, g, or t
aacgcagataaggcaactcttatggagcttacagtccagtgggcaagcgcataattgcaagaggtactaagtgctgtgaaggaaatagattgctctgttaaggaataggaagtgagaagtgatcaaatcggaaggagctgccatatatgaagcagggcatatgcagttctggcagagggaaaagtatgttcagagattgacgggactgctgaacggtactgttcaacagcatggcctggtggaagatacagaaggctggcgttgctggaggtagggagtgactcacagacagtgatgagatgagggtggtgagatcatgcaggaccttgggaaccaaggtgaggaagtaagagtttactttaaatgctttaggtagtaatcacaattttaaacagaagtgacatgatccctctgtaaatgtctgtggaaataaattgagttgaataccatttgaattttatctacagaaaagtatccagtgtattgcagcttttttcctgcaccatacagcccaattttgtcaagggtctagtctagtgataagctctgaagtttttggtattatttgctgaactggattgggttggattggattagtacactggaatcatgtagcatcagttgcctagtttgaattgagatgatctgataccctctccatttcagagtgatttattctgaaatggagtgaataaatgccacactgtgcgtcagaatgacctgtgcatcagaatggcctgtggcactttttaaacatacagatgcctgaggtacagatctcagtccaaaccgactggatcagaatctctagaacagtagttttcactctcgatgtgcattgaattcatctttcatgcatattccagattcttttatgtcatttagctcctaggncagtggagggacaggaatcaagaagagggtatggaaactgaatgcacaaaactggagggattcctatgtttacaaaagttaatttgggcatctcctgagcttggcagaaaaggatgaggatgatgtttctgtaaaatctgaaaatcaaacaaaggcaattttgtttactatagatggtttttaacacaccttagtcatggccttgacaaacctgatgtgatttaagattctgttgatagctnttgcccaagtgagatctttgaatacctactttcaattaatataacttgtaatttctctctggaaaggatagagtcctaatcttaggttcattctttttacaaattaattatgtagggtagaatttacaggattgcaacactgttgtgttagaaatctttatatagtaagaaagttatttgcttctaanattcgatgttttggggcagctgataacttgtgtagccatgactattgagtcagaactgttacnattcaggcaccctctataggtggactttccagtagttgctttaatgaaaacgtggtttttgtggcaatacttttttcctttaagtaaaaaattttaaaaaacaaaaataaaaagtctgtgtatttagtagcatacatcttacagatcttgggaaaaaaccccaagtccctttgtttatgactaaataactttcttcctatatgtagaaatgagtattgtcctgataataagcataggacaactccttgacttgagattaactccaatggcatatatggtctgtagatatttttgtgaaaaattacagttgtagatgtttcagggtttatttgtgaactcagtttcactactaacaaggcaattatactacttaacatgttaaacaggttttagaaaatagttttgtaattataagggtaataagtgaaaagtaagagaaacaaaaggcataaaacaaaacaatgaatattttaatctttatttttaaattgttttcttacttttttaaatactatcggtgaatctggttactgccagctgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttccataaactaatattagtcagca

SEQ ID NO: 332429 - DNA, 1694 bp, Homo sapiens
ctcaacgctttatacttcctcacgcctttatattccaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttccataaactaatattagtcagca

SEQ ID NO: 332430 - DNA, 3476 bp, Homo sapiens
aggggggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattgttttggtaatttgtgcctttcaaggaatttgtccattccatctaaatgttgaatttattggtataaagttattgacagtattcccttgatatccttttaatggctacaaaagccatagtcacttgtcctcttttgttcttaatattgttaatttatatcttctcttttgttcattgctttagttaggggtttgtaatttttattgatcatttaaaggagcaacttttggttttactaattttctctatttgcttattttctatcgcattgatttctgcagttatctttatttctttccttctactttgagtttgcttttcttctagcttttttaaggtagaagtttatattagtaattttagaacttttctctctccaagcactgttttagctgcatttcacaagttttgatgtgttttcatgaacgcgtagttcaaaatagtgtcagatttcccttgtaatttaattttgatctatgacttttctagaaatgtgttaattttcaaacatttgggggagttttcattactattgggtcgacttgatcctttggaatcttgtttgtttttaatgtttgttagggtgggtgtaaagttgtctttatttaaggacggtggttgtcaactttcagtctcatgaccccctgaaactctaaaaacttattgaggactccgaagaattcttgcttatgtggattgtattaatgcttaccatatcagaaattaaaactgagaaataagtaaaacaatatttacttattagttccttttcaaatgacaataataaacccatttcatgttcagctctctcttaactatgttctttcttattagttttcgtttccttctaaccacaaataaacatataaaatcttgacctgccttgtggaaaatgttttctctcaaggatgagaaataaaatgagaattctggacttacttcttatcaacattaaaaaagccatgggggttgtatttgttgacctttcctgtttgtatattagttttctgatatggagaattgttctgctttttcgtcctctaccagtctgattaattcgtaggcttaacacttcctttttctttctccttggaatgcctcttgggatatgcattagttggtcttatgtcttttcttggtctaggtggtgtgtgtgtttggcttgtttggggcacttttagaggctccagctgcacatttccactcctctctgtgtgttcctctctgcatctgctgtttgtgtgtgtacactttttttctgagcaatctttctccttagccacattgagttctttaacagtttttctgttttcttcttcattaagataattaataatcatactactcacatatcatgttttagaacttcctaagcctttccctttcccaccttttggacctcctaactgaatttcaaagtcttcattccttagattaaaaaaataaatccaaagataaaagaatgtaatgtcttataagtcgtatcagtgtatattttctctgttattgttgttagtgttataataaatcctaagtgacacaattcctttctcctacattaattcatttgcttgtacaacaactatttattgagcactgtgattaacaatataatcaaattccctgccttggaatttacattccaattcaaagagacaaactgtaacaataaacactatgtccttatattaagtagtaataagtgctgtggagaaacagcagagtaaaggggataaagaacgtattgttaggttgttctaatataaagatgtgtcaggagaggccttggtgacatttaagctgaaacgtgaaaggagcagagggaattaggtggatatgtgggagacgagaggtcgaagcaaaggagcagcacgtgtggaggttccgaaacagtaatgtgcttggtgtgcttgacccaaggaggccagtgtagctggagtgcagtgaacaacagggagaggggctggagattagatcagagtgttaatggggtggtggatcacgtaacaccataaaagccttggtggaaggactctggctgacatcacgccccaagttgccccatactttccagaataccaagtaggtccttgctgttcagaattctgttcaatgtagcagcccctcccattgcgtcttcaaatgtgtgagagagaacattgacagcagagtaagtcatggcttgattacagacattgcatggg

SEQ ID NO: 332431 - DNA, 1219 bp, Homo sapiens
tatcaaaagattgttttctctttcaaggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttccataaactaatattagtcagca

SEQ ID NO: 332432 - DNA, 2023 bp, Homo sapiens
aggggggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattgttttggtaatttgtgcctttcaaggaatttgtccattccatctaaatgttgaatttattggtataaagttattgacagtattcccttgatatccttttaatggctacaaaagccatagtcacttgtcctcttttgttcttaatattgttaatttatatcttctcttttgttcattgctttagttaggggtttgtaatttttattgatcatttaaaggagcaacttttggttttactaattttctctatttgcttattttctatcgcattgatttctgcagttatctttatttctttccttctactttgagtttgcttttcttctagcttttttaaggtagaagtttatattagtaattttagaacttttctctctccaagcactgttttagctgcatttcacaagttttgatgtgttttcatgaacgcgtagttcaaaatagtgtcagatttcccttgtaatttaattttgatctatgacttttctagaaatgtgttaattttcaaacatttgggggagttttcagttatcttttggctatcgattttttaaatttattgtggttagagaatttgctctgtattttcaatcctaaatgttttatggcccaaaattatggtttatcttggtaaatgatccttgtatatttgaaaataatgtacattctgctattttggggaatattactctataaatgataggtcaaatcggttgacagtttttttcaagtcttctgtatacttgctgatt

SEQ ID NO: 332433 - DNA, 1939 bp, Homo sapiens
gtctttgtcctatcaacaagtgagagatgattgttgaaatctccaaatataattatagttttttgtttctctttttagttctgtcaggtttgcttcatgtattttgaagctgtataattatatgcaaatatgctaaggattattatgtatttttaatgacataattctttcatcattatgaaatctccatctttatcgctgataatattccttgtcctaaagttcaaagagcattgaggtgtgttttggcaggcagttgagttactattgggtcgacttgatcctttggaatcttgtttgtttttaatgtttgttagggtgggtgtaaagttgtctttatttaaggacggtggttgtcaactttcagtctcatgaccccctgaaactctaaaaacttattgaggactccgaagaattcttgcttatgtggattgtattaatgcttaccatatcagaaattaaaactgagaaataagtaaaacaatatttacttattagttccttttcaaatgacaataataaacccatttcatgttcagctctctcttaactatgttctttcttattagttttcgtttccttctaaccacaaataaacatataaaatcttgacctgccttgtggaaaatgttttctctcaaggatgagaaataaaatgagaattctggacttacttcttatcaacattaaaaaagccatgggggttgtatttgttgacctttcctgtttgtatattagttttctgatatggagaattgttctgctttttcgtcctctaccagtctgattaattcgtaggcttaacacttcctttttctttctccttggaatgcctcttgggatatgcattagttggtcttatgtcttttcttggtctaggtggtgtgtgtgtttggcttgtttggggcacttttagaggctccagctgcacatttccactcctctctgtgtgttcctctctgcatctgctgtttgtgtgtgtacactttttttctgagcaatctttctccttagccacattgagttctttaacagtttttctgttttcttcttcattaagataattaataatcatactactcacatatcatgttttagaacttcctaagcctttccctttcccaccttttggacctcctaactgaatttcaaagtcttcattccttagattaaaaaaataaatccaaagataaaagaatgtaatgtcttataagtcgtatcagtgtatattttctctgttattgttgttagtgttataataaatcctaagtgacacaattcctttctcctacattaattcatttgcttgtacaacaactatttattgagcactgtgattaacaatataatcaaattccctgccttggaatttacattccaattcaaagagacaaactgtaacaataaacactatgtccttatattaagtagtaataagtgctgtggagaaacagcagagtaaaggggataaagaacgtattgttaggttgttctaatataaagatgtgtcaggagaggccttggtgacatttaagctgaaacgtgaaaggagcagagggaattaggtggatatgtgggagacgagaggtcgaagcaaaggagcagcacgtgtggaggttccgaaacagtaatgtgcttggtgtgcttgacccaaggaggccagtgtagctggagtgcagtgaacaacagggagaggggctggagattagatcagagtgttaatggggtggtggatcacgtaacaccataaaagccttggtggaaggactctggctgacatcacgccccaagttgccccatactttccagaataccaagtaggtccttgctgttcagaattctgttcaatgtagcagcccctcccattgcgtcttcaaatgtgtgagagagaacattgacagcagagtaagtcatggcttgattacagacattgcatggg

SEQ ID NO: 332434 - DNA, 648 bp, Homo sapiens
gacatttaattaattttcaatttaaatcagaatcttttttccaatcaaaagagtttgaattaaatatttagaaattatagtgctttgggtattcctgatttagaattgtcatgttaattagtacttataaagttgtgagtgggaaattattattcatcagaaagatgaagcacagctctttggcactgccgtgtattacatgtttgagtctgtatgctcctcaggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagtaagtagaacgtgtgtttaaatatggcattaagatgtgttctgatggttgtataaatgcatgcattaggtattttcaggattgtagaatgggtatagaatattatgcattttagttatagacctctctaactagagttaatattctgacataatggcatggaacccaagagaaaacttgacagttggacataaaaaactggtgtatatacagaggaaa

SEQ ID NO: 332435 - DNA, 2465 bp, Homo sapiens
aggggggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttccataaactaatattagtcagca

SEQ ID NO: 332436 - DNA, 447 bp, Homo sapiens
aggggggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaaggagcgtgctcgagagcgagccctcgatgcttgcgcatgcccccttcgtctgcccg

SEQ ID NO: 332437 - DNA, 1740 bp, Homo sapiens
tccttactcttagtttggtgctcgtctgacatggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttccataaactaatattagtcagca

SEQ ID NO: 332438 - DNA, 2411 bp, Homo sapiens
aggggggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttccataaactaatattagtcagca

SEQ ID NO: 332439 - DNA, 2116 bp, Homo sapiens
aggggggggccagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggtaagttaaattttcctctagtgctgatttacatgactttgtagggttaacactgcagataagccaggcaaatagttagtttataaatagtgttccagagaaccctagagattttgagaaagtatcttgggggtcatgtgaatttgttgagagaaatggacaagtaaatgaggctccatagtctctaaccagagaatttctgctgttttaaagattcaacttgtttttcactgttcagtggcctaaatgtagattatgagaaataccacattagaccagtagaatcagctttaagactgggaaaacaacttcttacagtgtttttgctcaaacttccaatttaatgtcaaataaacaaatattccataaagatcattataaagaaaatttaatgtgtggatgtgtacttttggcagtctctctgggatcatttcttaatcaactaggtatattttttaaaatctcgtttttagggttaccttatgacaagtgtaacagtaactccaaccttagagactataacatgattaaagaaagttatgaagctccagttatacaatggggataaaatatgaattatatacccagaatgcaattgagttgtaggtgttgaatctttggaaaatgccctctagcttctggaatgaccctgatggatgggtttaagtttggaaagatggacatgatattaatctgatccagagctgacacattttcaactccagtttgaaaagagaaggatgataatgagactttgggccattacctgtgtggcatatctagtgaaaagaatctacagtgtgcgtttggaagtgaagatttagatttcttcccagtggagga

SEQ ID NO: 332440 - DNA, 435 bp, Homo sapiens
  misc_feature (376)..(376): n is a, c, g, or t
  misc_feature (414)..(414): n is a, c, g, or t
tatgacaggtatataacaggtatatataagtgttagcctacttatcaaattagaagggataaataaaaacagattgtcaattctcaggcccattctaagaattcttatgtccattctataagtaagttagcagcgccaaaagtaacaatgaggtggggtgcagtggctcacaactagcactttgggaggccaaggtgggaggacagcctgaggccaagagtttgagaccagcctggacaacatagcaagatcccgtctctatgaaatttttaaaaatagccaggcatggtggtgcacacctgcatttccagctacacgggaggatgaagtgcgtacagaggggctcgcagtgctgttcatcggagccatcagagcnatcacgcagaccatcacaatgtttgctggatgggatgnaagtgccattgggtcagcggg

SEQ ID NO: 332441 - DNA, 3596 bp, Homo sapiens
acttactgtcattaaaccagtatgatgatggagtggggaatgcctcagtttctcccaccgccgagggcctataggactacagttcccagggccccgtgctgcaggctagcggcctcccgccaatgctggccagtaacctgagcatccctctccaaaaggtcacttcagggctccttgagggacagcaacagggggagcctagagctgctcagcttcggtgggggtggagtgagggctgtggccctgcctcacacaacctccctcacaccacccctgcaatgcagggtcgtgggcccctttctcaaagacatccagtggcctctgctagttgcacctcttccgtcaggggacactgacttggctcctgcaccacagcctgcagggggtcctggttccttttgccacaacacatggcctcccatcctggttcagccactgacagacagctccccaatccagcactctgcctgctccttcttgtatccaaccctccaaaaggcagggacaagggacagaagaccatgtgcaaggcctggaggaagtgggtcagcacaggcctgtgaacaagccaggccagtcttggcggcccaagtggagctcacctctccctcccctctcctctcctccccttgccctcaaaatagctccctgagctgccaggccaagaccctcccattgcaggggaggcggggcgtgctgcccagagccaggctttaaatccccttgaggctggggagctccactccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaagaggatctactacctgtctttagagttctatatgggacggacgctacagaacaccatggtgaacctggccttagagaatgcctgtgacgaggccacctaccagctgggcctggacatggaggagctggaggaaattgaggaggatgcggggctgggcaacgggggcctgggccggctggcagcctgctttcttgactccatggcaacactgggcctggccgcctatggctacgggattcgctatgagtttgggatttttaaccagaagatctccgggggctggcagatggaggaggccgatgactggcttcgctacggcaacccctgggagaaggcccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcggcgctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggccgatgactggcttcgctacggcaatccctgggagaaggcccggcccgagttcacgctacctgtgcacatccgtactgg

SEQ ID NO: 332442 - DNA, 437 bp, Homo sapiens
actgcctccatgtcatcaccctgtacaaccgtgagtggcagccactctaccctgtctctcagtgctcccccgtgttcctgcggcatagtacatattgcccaaccaacatctcctttggacttgggactactcttgggacatggaattatccccatttcacagatgggcaaactgaggctaagagagcatagcaagtgattgttcgagtcaggcctacggtgtcccagcccagcctctgtcaggagctactacccagagggaaaggtaggcccactggatccctctcgtttctccacaggcatcaagagggagcccaataagttttttgtgcctcggactgtgatgattggagggaaggtgagaagccaggctccagccctgggctcccgtcctttgatatatccaggttgaggtcagcccagctgagttgcaggata

SEQ ID NO: 332443 - DNA, 3616 bp, Homo sapiens
acttactgtcattaaaccagtatgatgatggagtggggaatgcctcagtttctcccaccgccgagggcctataggactacagttcccagggccccgtgctgcaggctagcggcctcccgccaatgctggccagtaacctgagcatccctctccaaaaggtcacttcagggctccttgagggacagcaacagggggagcctagagctgctcagcttcggtgggggtggagtgagggctgtggccctgcctcacacaacctccctcacaccacccctgcaatgcagggtcgtgggcccctttctcaaagacatccagtggcctctgctagttgcacctcttccgtcaggggacactgacttggctcctgcaccacagcctgcagggggtcctggttccttttgccacaacacatggcctcccatcctggttcagccactgacagacagctccccaatccagcactctgcctgctccttcttgtatccaaccctccaaaaggcagggacaagggacagaagaccatgtgcaaggcctggaggaagtgggtcagcacaggcctgtgaacaagccaggccagtcttggcggcccaagtggagctcacctctccctcccctctcctctcctccccttgccctcaaaatagctccctgagctgccaggccaagaccctcccattgcaggggaggcggggcgtgctgcccagagccaggctttaaatccccttgaggctggggagctccactccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaagaggatctactacctgtctttagagttctatatgggacggacgctacagaacaccatggtgaacctggccttagagaatgcctgtgacgaggccacctaccagctgggcctggacatggaggagctggaggaaattgaggaggatgcggggctgggcaacgggggcctgggccggctggcagcctgctttcttgactccatggcaacactgggcctggccgcctatggctacgggattcgctatgagtttgggatttttaaccagaagatctccgggggctggcagatggaggaggccgatgactggcttcgctacggcaacccctgggagaaggcccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcggcgctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctcctta

SEQ ID NO: 332444 - DNA, 3589 bp, Homo sapiens
acttactgtcattaaaccagtatgatgatggagtggggaatgcctcagtttctcccaccgccgagggcctataggactacagttcccagggccccgtgctgcaggctagcggcctcccgccaatgctggccagtaacctgagcatccctctccaaaaggtcacttcagggctccttgagggacagcaacagggggagcctagagctgctcagcttcggtgggggtggagtgagggctgtggccctgcctcacacaacctccctcacaccacccctgcaatgcagggtcgtgggcccctttctcaaagacatccagtggcctctgctagttgcacctcttccgtcaggggacactgacttggctcctgcaccacagcctgcagggggtcctggttccttttgccacaacacatggcctcccatcctggttcagccactgacagacagctccccaatccagcactctgcctgctccttcttgtatccaaccctccaaaaggcagggacaagggacagaagaccatgtgcaaggcctggaggaagtgggtcagcacaggcctgtgaacaagccaggccagtcttggcggcccaagtggagctcacctctccctcccctctcctctcctccccttgccctcaaaatagctccctgagctgccaggccaagaccctcccattgcaggggaggcggggcgtgctgcccagagccaggctttaaatccccttgaggctggggagctccactccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaagaggatctactacctgtctttagagttctatatgggacggacgctacagaacaccatggtgaacctggccttagagaatgcctgtgacgaggccacctaccagctgggcctggacatggaggagctggaggaaattgaggaggatgcggggctgggcaacgggggcctgggccggctggcagcctgctttcttgactccatggcaacactgggcctggccgcctatggctacgggattcgctatgagtttgggatttttaaccagaagatctccgggggctggcagatggaggaggccgatgactggcttcgctacggcaacccctgggagaaggcccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcggcgctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcgtgggtgaccgcctccgtgtcatcttcctggagaactaccgagtctcactggccgagaaagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctcctta

SEQ ID NO: 332445 - DNA, 640 bp, Homo sapiens
acagctctgtcctggcaggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctcctta

SEQ ID NO: 332446 - DNA, 226 bp, Homo sapiens
aggtgtgctaggtagttgtcgatctgatctagaggctttgctggctcatcaggcttatgtcttgggccgactggggttgcacaatacaagcccaagtgcacctgaggggcaggggctgttttcctcagctccagagcaatcctcatcccctcttccagcaggatcttgctccaggttacttacgagacaacctctgtgtatgtgtctgcctgtctgtgtgtctggg

SEQ ID NO: 332447 - DNA, 446 bp, Homo sapiens
atcaatataataggtcagtgcatttaaaccaagattgtgccatttttaatatttcacattgcctcttttaacagaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttgga

SEQ ID NO: 332448 - DNA, 2088 bp, Homo sapiens
gcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttgga

SEQ ID NO: 332449 - DNA, 2318 bp, Homo sapiens
gcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttggattatcttttgtctgtttattactacaatatgaagtcttgtttcagtggctaatgacatcatttctgtagacttacaatacactctaggtgaaagataatgattacagcttgaaagataactatttgctgtttctttgggaagagtatttatagtaattattacttatctttgcaatagaaattctaccaccttgccctctatagcttagccagttagtatcagtgaagat

SEQ ID NO: 332450 - DNA, 1912 bp, Homo sapiens
gcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcccttatcgagggcccttgtcgagtggcccttatcgactggttatgagttggcccttatcgag

SEQ ID NO: 332451 - DNA, 2206 bp, Homo sapiens
  misc_feature (2202)..(2202): n is a, c, g, or t
  misc_feature (2205)..(2205): n is a, c, g, or t
gcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaaaaaaaaaaaaaaaaaaaaaaaaaaaaaaaaaaaaaaaaaaaaaaaggagggggggcgccgccccagaagaaattccccccgaggggggcccccgagtgaaggcggccaccccgtttttgtgtggaaagaagggggcgccccaaagagagggagcggatatatagatacggctgcagcgcacgcgaggggcgcgcgcggtattataacaagagcggcgcgtggagagggaggaaagaagtgtgcgacagccgtggcgagaacacctttgtgggaggagaggacgaccctttaaattgtggggggggggaggagacaccaatatggggggaacaacactcaccaccaagagagagatattataaacagcgctcagaagggaggagaaaaatataataaacaatgttttagaagggggggtgtatcaatgggtgggtgctaacaacaaaaatagggcggctgaaatatatgtgcggtggcgagaggtgatgatgagaaaatattgtggggcattaaaacgagcgggaataatgagtatttttgtggagagacaaacttattttatatacccgggagggagctagaatagtataaataaaggggnggna

SEQ ID NO: 332452 - DNA, 1905 bp, Homo sapiens
gcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcatggatccgagatctccaaaaaaccttagcaaacatttaccaataagtataggcgatcgaaattggagactggcgcatagatatagttgccgcaggcatgatcgcacattttaccaggcattatatagcaggagaaccctttctctgcttatgattagttgaatacttgcaaggaagcaagtagacccgaaacagagaggtctaaaagtaaaagcgcccttttgcaatatgggagtttgtgggcgcaccccgcgtgtggggtccgaaaatctgactatcgcacctcctgttggaaaaacaaaaaggggtcggggccttggctgttacggga

SEQ ID NO: 332453 - DNA, 872 bp, Homo sapiens
gcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatgttaatttatattgatactcttttcagtgataaagtgttttcattaaaacacaataaataaagtctatggctttaaaaaatattaggtaaa

SEQ ID NO: 332454 - DNA, 438 bp, Homo sapiens
aaaaggacgagaggtcgtgaacaaagatttagaattgaaaactcttgtagtgagtgatttcattgatgaaatcactggatgttttatcatggaaaaggagagaaagtagagtttatgaacatatggatttgactttttactcgaactgtttccactaaaataaggagtgattaaatcatagttgatatgcctgtgtaatgcttttaaaggagtttgaattagttttgagattgattactgttttctaaaacacatataagtttgggttagttttggaatttatatattttgttctggtagacttggttcttttgaggggaccgataggggaatttgtatatttgtttgataatactgatataaccggttgtaattccacagttctgacatttatttctcttcacagaggccccataaagccactgccgaagaaatgac

SEQ ID NO: 332455 - DNA, 338 bp, Homo sapiens
aggagttttagacttgacattttttacatttttatttgtttttaaaatatttagaaaacccattttggttgagtaacatttgcacttattatctttttaaaatttatttttcgaactgttgcagtatgcagattttgttgttacccaaatcttcttgtcttaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatggtaagtgttctcattacaatatctttattgtatg

SEQ ID NO: 332456 - DNA, 244 bp, Homo sapiens
agttgccatataatgattactttgagtattttggaccagacttcaaactgcatattagtccttcaaacatgacaaaccagaacactccagaatatatggaaaagataaagtaagaaatcattgaattgttttgataaacattttatcttgacaaagatttagtatgctttaaagggccaagtatgatgggtctttttaactttattagatattttgtttttttctaaaggatttgaaacattaa

SEQ ID NO: 332457 - DNA, 2041 bp, Homo sapiens
gcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctg

SEQ ID NO: 332458 - DNA, 799 bp, Homo sapiens
gcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatgttaatttatattgatactcttttcagtgataaagtgttttcattaaaacacaataaataaagtctatggctttaaaaaatattaggtaaa

SEQ ID NO: 332459 - DNA, 1865 bp, Homo sapiens
agcatggctgtctttcagtaaaactttttttatggacactgaaatttgaattttgtataattatcacacgtcagaaaatactcttgttttggttttgtttttaaaccatttaaaaaataataaaaacttcttagttcaaagctgaaaaaagaggcaattggccaaatttgggccatgggccatagttagccaatccctattttatactattgaagatttactacagaggtgttttaattaacaatcttgagtatggtataatcttcagtttttaatatattagaaatatgtgctatgtttttgaagcatgtagaatagaacagatttcacaaagagtaaatatatattttttaacctacattgggccacaagtgggtatttaaaggcctgaggctcaaacctcagatatttgaataacctcttaggctgaatgtaaaaggtgattaaacattctggaatgcaagagctcaaaaatgggtttcctgaatttgtggtgcttcttcccatcttagaacctttaaaggaaaaaccaaaacttatggatttgttttcaggtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttgga

SEQ ID NO: 332460 - DNA, 527 bp, Homo sapiens
gcggccgcctactactactacaactgctcgaattcaagcttctaacgatgtacggggacatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttggattatcttttgtctgtttattactacaatatgaagtcttgtttcagtggctaatgacatcatttctgtagacttacaatacactctaggtgaaagataatgattacagcttgaaagataactatttgctgtttctttgggaagagtatttatagtaattattacttatctttgcaatagaaattctaccaccttgccctctatagcttagccagttagtatcagtgaagat

SEQ ID NO: 332461 - DNA, 310 bp, Homo sapiens
agttgtttcttctggtaacacttcgagaaatttcaaatttggatctgtgttaagaaaattgaaactataaggaaaaaatgactgcctccctctgactggcagacattttaaagtgagaaaagcaactgaaataatttataatcaagcggcttttagtatttagtattcggcatttattagaattataaattaacatagattttaagtaaaacatactttaatacgaagtgtcatagaaaatttattgaatttagattgcatgacttctcttctactaacacaactttttttttttttttttttttttttt

SEQ ID NO: 332462 - DNA, 445 bp, Homo sapiens
ggagagggaaaagcaaaaagctaacagcacaacaacaaaacaaaaaccacttcagacttcaaggagtttttaatcatgagaatgtacagcctgtgtcctaaccatctttcagccctaaacatattcccacagacaggcagcacattcatacaccctcagacaacacactactccgtcctcacactttagagtagaacgcaagttacaagacaatgtcaattaatgttgttgtaggaaacagtccattggaaggactggaactgtcagctgtatgtcaggctctttccctgtactgtctcattcaatcttcgtcactttagagaaaactgaggcctaagaaagttcattacctttctgaagaccacacagataattatgaaagttttagaattcaaccctcattctgacttcaaagcctacaacaccaccacaccacagtacagag

SEQ ID NO: 332463 - DNA, 277 bp, Homo sapiens
tcctcactggagtcctgcctagaacagagattgaactctgtgctggttaaagtcgaacccatttcccatagagcgggagtgggtagaaaaaaagcagcaagctgagagctgtctggaggcagttggggatataataaattaggaagtcacacagctgtgtgttctgaaacacaagattgaaaatagatcatttttttcctcttgggggaacatactgtagtgttgatattttctaattcaaatttggactcagtgggccttctcaaccaaattaccc

SEQ ID NO: 332464 - DNA, 193 bp, Homo sapiens
ccaccactctctgtgagtacaccatgtgtgcccatggccagatggccagcatgcatgatgagaatggagtcaggtaataccaatgtctcagactaagaagctcgaagatataatcttgtgctccatcactcctaaataccattttcaaagtattccctcttggaaacataaacgtccctaacccaggtctgaa

SEQ ID NO: 332465 - DNA, 286 bp, Homo sapiens
ggacttttccaaccagaggaggaaagctcatagtggcttaaattgaggggaaggtaatcacattttcttcctttctctattccaacaccttagctatttcttgacatacaataggtgctcgaaatgacaaagatggctattgtcccccagtatgcatttcatgacttgtgctttgtcaatagaatcccctggtttagccgaggacaaggctacttgccagtaggtgttttcaagttctggctaatgggagcagaagagatgtataccacttctagattatactctt

SEQ ID NO: 332466 - DNA, 189 bp, Homo sapiens
ttcccatgaggtcagtccttatgcatcgccatcctgactgttggtggccgcagcgctcatcctcagccccaggtgtgcaacaaaaaaggagcttctcccaactcctaattgcatggaaaggctgcaggtatttcctggctttacttgcataacctttaggtatgtgttgtctgaaaccacgtctttccc

SEQ ID NO: 332467 - DNA, 318 bp, Homo sapiens
tccatgttctatgctttaaaagaagagctggttttttgaatgtaaatataaacagagcagacataagcctgaaggaccaagtgtgtgagactctacaaggcttgaaccaaccataggacacactgaggggactccagagagatttggattagccttactaccatcactgatggcagtgaacatggtatgcctccatcttctcaagccctgacagggccaaaaggaggcttcttcttccacactattcttccactgaggatccttggcttctccctcccctcccctcaaagacagactcttctacaccaaagccctcag

SEQ ID NO: 332468 - DNA, 117 bp, Homo sapiens
cctacagcacccggtattcccaggcggtctcccatgcaagtgctaaccaggcccgacactgcttagcttccgagatcagacgagatcgggcgcgttcagggtggtatggccgtagac

SEQ ID NO: 332469 - DNA, 356 bp, Homo sapiens
acacaagttattcaacatctgaaagcctcagtttcccccacaagtttgttaactcagagaaaacttgtaaaatgctagggactgaactaggcacagactaagctcaataacagttttcagtcttggttttctccttatgctttttttgactcccaccactgtaccttgagtttcttttttttgtatttttatttatttatctatttgagacagagtcttgctctgtcgccccaggctggagggctgtgacacaatctccactcactgcagcctccgcctcccgagttcaagcgactttcctgcctcagcctcctgagtgagtagctgagattacaggcatgagccaccacacctgg

SEQ ID NO: 332470 - DNA, 218 bp, Homo sapiens
gataaaagattcctctgggtggggtatgctttccataccagggtaagaaaacagcccttacagagacttggaattgaaggctgcaatggacctacataaactgaacaaagtaacctttatcttccacctatccatccccccaccacctacaaccatgtatctcctagtgactaccctagagccaagcatggtgactcacacctgtaaccccagcactt

SEQ ID NO: 332471 - DNA, 255 bp, Homo sapiens
agatggagtttctgttgaacaggctggagtgcagtggtgtgatcttggattactgcaacctctgcctcccaggatcaagcaagtctccggcctcagcctcccatgtagctgggattacaggcatgtgccattgagcccggctatttcactgtggacgttgtcatctttgaaggcatcactcatgctctatctcatctagatactgagtgtcacttggtgtgtcaataaaagtttctaacattttttttttttttt

SEQ ID NO: 332472 - DNA, 488 bp, Homo sapiens
tcttggttctagttttagtttttcctttaagtaaatcatgaccttgagcaagatacttaaccgtattcttctttttctcttcacttgcccaactacttactcacagagttttcatgaaaatgcaataacaagtataaaaatgctttatcacatactaataatgtaatagtccgagtaattgtgcacatgctgttcaaactgtctttccccctggcctctactgtaattttgttaaagtattcctaccacaaagacatacagaaaaaaattgagttttctgtatatttctgtatatatgagaaaatttaattaggttacacagttaaattcagtaaattcttgaatgtcaagatatgattttcaactatgttaggcaatccttaaagcccatacaaccttgtttaaaatatgaatttggctgggcacagtggctcatgtctgtaatcccagcactttgggaggccaaggtgagtggactgcttgagccc

SEQ ID NO: 332473 - DNA, 490 bp, Homo sapiens
ggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacat

SEQ ID NO: 332474 - DNA, 537 bp, Homo sapiens
tcctgattattggtacagttaaaacctagaaaggctcattcatataagggatacattgtgttggaagagcttataacaactttgttttatattttgccaaaaagcctttggattctttagctcgagggtgtagtccagattccaggtccaacttctagagttctggaggagtggcagatatccatttcttggggatcagtcagaagtgagctcattaattaattggaaactttttgttttggatgtttcagtggtaaatgaaaacaataccccctactagaattattgtgaggattctgttacattatgtgtgaaagaactgattacaggtgtcacaaattactttcttactcattaatttattaattatgtgctatgcactgttttgttttgtttttgagacagggtctctgttgtccaggctggagtatagctgtgcagtgtttttaagtgctgggaatactgtgatgagcagaatagacattgtgtctgccctcatggatccttcagtaaagtgagaaaggcaaacatcaaaca

SEQ ID NO: 332475 - DNA, 987 bp, Homo sapiens
acatacaacaatgaaaatggaattatactgttcattgtgttggtaagtttttcccacttggtaatgtgtcataaatcgttttgtcattaaataatctacaacatgatttttcatgactccatatggatgtgccatgatttagctaactaatctactatcgttaggtatttaggtcttctgttttcactagtacaaataaaatgttttaacttccttatgtgtggagctctgtaaaaagatttgtttccttaggcacctagaagtgggattgctgagtcaagggttacaccagagtttctcagcctcaacattattgacctttggggccagataactgtttgttgtgtggggcttacgtttagtggcatccctggcctgtacccaaaagattccggtagcacccctctccccaagttgtgacaatcaaaaatgtctccagatgttgctaaatgtcccctaagaagcaaaattgcctccttttaagaaccactgggttatacaatttacactccagttaggagtgtatgtaaatgtttttgttcctgtatcctcaataacagtgaatattaccaattttaaatcttcatatactaagaaaagggggttggggtgtggacaatcaatatacctagcagtgtattgtgaattatccccatactgtggcttctaatatgctgttatctgactctaccgggatcattagtaaatgccaatatatgttaataatttcctaggtttatatactattttgagttaatagcaattttcagacatcttaaagaccattttcatgattctaaaaaattacaaaatccaaaatgttttaatttttgaagggaactattaccttaggaaaatgggtgaggggcctggtgcaatggctcacgcctgtaatcccagcactttgggaggccgaggtgggtggatcacttgaggtcaggagtttaagaccatcctggccagtgtggtgaaacccccatctctact

SEQ ID NO: 332476 - DNA, 1197 bp, Homo sapiens
ggctgggcgttgtggctcacacctgtaatcccagcactttgggaggccaaggcaggtggatcatttgaggtcaggagttcgagaccagcctggccaacatggtgaaaccccatctttactaaaaatacaaaaattagccaggcgtggtggcgcatgcctgtaatcccagctactcaggaggctgagacaggagaattgcttgaacacaggaggcagagtttgcactttgctgagatcctgccactgcactccagcctggggcacagagcaagactccatctcaaaaacaaacaacaacaaataatctacaacatgatttttcatgactccatatggatgtgccatgatttagctaactaatctactatcgttaggtatttaggtcttctgttttcactagtacaaataaaatgttttaacttccttatgtgtggagctctgtaaaaagatttgtttccttaggcacctagaagtgggattgctgagtcaagggttacaccagagtttctcagcctcaacattattgacctttggggccagataactgtttgttgtgtggggcttacgtttagtggcatccctggcctgtacccaaaagattccggtagcacccctctccccaagttgtgacaatcaaaaatgtctccagatgttgctaaatgtcccctaagaagcaaaattgcctccttttaagaaccactgggttatacaatttacactccagttaggagtgtatgtaaatgtttttgttcctgtatcctcaataacagtgaatattaccaattttaaatcttcatatactaagaaaagggggttggggtgtggacaatcaatatacctagcagtgtattgtgaattatccccatactgtggcttctaatatgctgttatctgactctaccgggatcattagtaaatgccaatatatgttaataatttcctaggtttatatactattttgagttaatagcaattttcagacatcttaaagaccattttcatgattctaaaaaattacaaaatccaaaatgttttaatttttgaagggaactattaccttaggaaaatgggtgaggggcctggtgcaatggctcacgcctgtaatcccagcactttgggaggccgaggtgggtggatcacttgaggtcaggagtttaagaccatcctggccagtgtggtgaaacccccatctctact

SEQ ID NO: 332477 - DNA, 441 bp, Homo sapiens
accaacctggccaacatggtgaaaccccgtctccactaaaaatataaaaaatcagctgggtgtggtggtgggcacctgtaatcccaactacttgggaggctaaggcagggagaatcgcttgaagtagggaggaggaggttgcagtgagctgagattgtgccactacactccagcctgggcaacagagtgagactccgtctcaaaaacaacaaaaaaatgaacaccagattattatcttctgatcctggaggtcaaaggtctagaaatcaaggtttgggcagggctgcattcctcgggaaggctccaggggagaaaccttttccttgccttgagaggcacccccttcctccgtcatcacagccccttcctccaacatcaaagcatctcactccagcctctgcttctgtttccctgtcttgggatccttaatttactcatatt

SEQ ID NO: 332478 - DNA, 399 bp, Homo sapiens
ttcctacaatatgttttgaaacaaatatatactttttttaagacagggtctcactctgtcacacagggctgagtgcaatggtgtgatctcgccccactgcaacctctgcattccatgctcaaatgatcctcccaagtagctgggattacaggtatgcgctatgacatctggctactttttgtattttttgtagagacagggtttcactatgttgtccaggctggtctccaactcctggactcaagcaatctgcctgcatcagccttccaaagtgctcagattacaggcgtgagccatcgcgcccagccaggattttgttttatacgatcaacatatatatatgtaagtgcaagtgtatatagatatttattaaatttaaaatgattaagaattaagcaa

SEQ ID NO: 332479 - DNA, 5165 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattc

SEQ ID NO: 332480 - DNA, 481 bp, Homo sapiens
  misc_feature (104)..(104): n is a, c, g, or t
  misc_feature (121)..(121): n is a, c, g, or t
tgaaagcgaatcatcagtagacgcacaagtcctgttatgacctgggttgtcgcttggcaaagtcagcatgtaataagacctttcttccatccgagcatcccctnccccatgtactttggtnagggctcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattc

SEQ ID NO: 332481 - DNA, 599 bp, Homo sapiens
  misc_feature (536)..(536): n is a, c, g, or t
  misc_feature (540)..(540): n is a, c, g, or t
ccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggaaccaacccgtgtgcggacaggaacggggggtgcagccacctgtgcttcttcacaccccacgctccgcgacgctggtcgctgactagtgcanccgngggaaatattcgcgtgagctcggtacccagcgctgcttgttttaaaccagcgtgttcat

SEQ ID NO: 332482 - DNA, 435 bp, Homo sapiens
cctagactcggcaccgttcggtctgacgcagtacagcgattatatctactggacagactggaatctgcacagcattgagcgggccgacaagactagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcc

SEQ ID NO: 332483 - DNA, 401 bp, Homo sapiens
gagagcctctgagcacgtcagccatgtcgaaccgctcaggaagggcagcaagaatttggcttctgacctctgcctctcctactcgccatctgcactgggtgtggttgtgcccattttacagatgaggaggctggggcatcgaccagctgaatgccttgtcccaggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcac

SEQ ID NO: 332484 - DNA, 3769 bp, Homo sapiens
ccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattc

SEQ ID NO: 332485 - DNA, 3704 bp, Homo sapiens
ccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattc

SEQ ID NO: 332486 - DNA, 4628 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggggccggggaggggcggggcgggatgg

SEQ ID NO: 332487 - DNA, 1421 bp, Homo sapiens
tgctgacctgtggactgggcatgagcaccgtggtgtcccatcacccttggcaatacagatgtgggagcagccaccattgtcacgggcacatgggtgggctgagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattc

SEQ ID NO: 332488 - DNA, 2843 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcac

SEQ ID NO: 332489 - DNA, 2351 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaa

SEQ ID NO: 332490 - DNA, 900 bp, Homo sapiens
gacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccaggcttggcaggctgcagggcaggtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccagggcggatgtgcctaccgaatcccactcctctgtgtgtgtccctttcaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattc

SEQ ID NO: 332491 - DNA, 470 bp, Homo sapiens
gagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcagtgattagagctgtactgatgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcag

SEQ ID NO: 332492 - DNA, 5060 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggatttta

SEQ ID NO: 332493 - DNA, 4386 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattc

SEQ ID NO: 332494 - DNA, 4008 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacccagaacagcttgcccagtgtgttgtctaccaccagggccacagggcggatgaggccggtggtgaagaggacctcgcgctcggtgccgtccagggctgcgcgttcgatcttggctgcccggtcctgcatgttggtgaagtacaggtaccctcgctccgcgttgacgacgatggccc

SEQ ID NO: 332495 - DNA, 3194 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacgtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcctgggaccccagggctggtgctctcatctcctttttccagatcatgagaatgaggctcagggaagtttgaaaaaaacctatcccaagtcacacagcaacaggagcaggatttgaaccc

SEQ ID NO: 332496 - DNA, 2372 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccggagacgccaagacagacaagatcgaggtgatcaatgttgatgggacgcagaggcggaccctcc

SEQ ID NO: 332497 - DNA, 857 bp, Homo sapiens
cgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggatttta

SEQ ID NO: 332498 - DNA, 116 bp, Homo sapiens
ctccgccagtgctcaggagtcttggtttctttgtcttacagccctttgttttgacctctctgagccaaggccaaaacccagacaggcagccccacgacctcagcatcgacatctac

SEQ ID NO: 332499 - DNA, 353 bp, Homo sapiens
aacaacagtggtcagcagcaggtgggaagcccatcgggccagagcacaggtgagacacaggtttgtgtatagatactggctagggtgatctgttcatggacttacaggtgaatacatggaatgcaaggcatcaagggcacgaagaaagtaacagaaggcctaggatggacagacgggagacaggagtctgcggggagtgagggtcagaggactgaatgatgcagctcaccagtaaccaaaagcggggcagggaaacagactgaacagagaagcaagaggccaggctcctcggggtaagtttattcgcctctgtgacagcagctcgcccctgagttgcagctcgcccctgagtt

SEQ ID NO: 332500 - DNA, 835 bp, Homo sapiens
aacaacagtggtcagcagcaggtgggaagcccatcgggccagagcacaggtgagacacaggtttgtgtatagatactggctagggtgatctgttcatggacttacaggtgaatacatggaatgcaaggcatcaagggcacgaagaaagtaacagaaggcctaggatggacagacgggagacaggagtctgcggggagtgagggtcagaggactgaatgatgcagctcaccagtaaccaaaagcggggcagggaaacagactgaacagagaagcaagaggccaggctcctcggggtaagtttattcgcctctgtgacacatgtagacgacctgtcccttcctgaccttttctttttggagatggagtcttgctctgtcgcccacgctgagtgcagtggcacaagcttggctcacggcaacctgtgcctcccaggttcaagtgactctcaagtgactaccagcgcccgccaccatgcccaactaatttttgcatttttaatagagatggggtttcaccatattggtcaggctggtcttgaactactaacttcaggtgatccacctgcctcagcctcccgaagtgctgggattacaggcatgggccgccgcgtctggcccttcctgaacttttgtactcaatttgccatagaatcacttcatcctaactgcgcaggagccttgaaaggtcacaaggtctgagcatccacctgctgctttgtcattcatctcatgctaatcctcctccacctgcatctaaactaaacatggaacagactgctcagtgactgggttttccatgactccagacagtgtcattctatcctaaccttccaaat

SEQ ID NO: 332501 - DNA, 3356 bp, Homo sapiens
gtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggcttcgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacatgatgatgctgcctctcctctctgtgttgtctgggcccttgtttacaagcacgcgttacccttcctgaggggagccatgctctagcccctggagggcctgttgcaggggcagggcgggcccgttgcctttggcagctcctggagagctgtggacatgcagtccccctcagttcgtgctgcaataaaggccatcttctctta

SEQ ID NO: 332502 - DNA, 3511 bp, Homo sapiens
gtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggcttcgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacatgatgatgctgcctctcctctctgtgttgtctgggcccttgtttacaagcacgcgttacccttcctgaggggagccatgctctagcccctggagggcctgttgcaggggcagggcgggcccgttgcctttggcagctcctggagagctgtggacatgcagtccccctcagttcgtgctgcaataaaggccatcttctcttaaaaaaaaaaaaaaaaaaaattttgggggccggcgccaaaagttttaacccttggggggggccagtggaaggcaggcccagagaagcggggagggggggttccccaaaaaaccggggcgggttgaacccggggtgggtggttaaaaggcggctacg

SEQ ID NO: 332503 - DNA, 3744 bp, Homo sapiens
gtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggcttcgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacatgatgatgctgcctctcctctctgtgttgtctgggcccttgtttacaagcacgcgttacccttcctgaggggagccatgctctagcccctggagggcctgttgcaggggcagggcgggcccgttgcctttggcagctcctggagagctgtggacatgcagtccccctcagttcgtgctgcaataaaggccatcttctcttatttctgccctcctttctctttggaccctggagccacaggctcagcctggcctgtcgccccggctgtcactgaaaagccccggataccaagaagtcacccacaaaaagtgggagaagaaataagatggcctttatatcgcaggcctccaccccacagtctgatttccatgtgctggatctgtttccaagccggccgggagcctcggtcctcgagtggccccacagctctagtggccctggagatagcagcctccccacacttgcctccttgtcctggggtggggacggtgagaaaccctggctgctggggcgtctgcagggctcctcgggccactgctgagcaggtgcatggacaccgtcagtgggtggaagcagcgccacatggtgac

SEQ ID NO: 332504 - DNA, 2321 bp, Homo sapiens
gtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggcatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggcttcgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacatgatgatgctgcctctcctctctgtgttgtctgggcccttgtttacaagcacgcgttacccttcctgaggggagccatgctctagcccctggagggcctgttgcaggggcagggcgggcccgttgcctttggcagctcctggagagctgtggacatgcagtccccctcagttcgtgctgcaataaaggccatcttctcttaaaaaaaaaaaaaaaaaaaattttgggggccggcgccaaaagttttaacccttggggggggccagtggaaggcaggcccagagaagcggggagggggggttccccaaaaaaccggggcgggttgaacccggggtgggtggttaaaaggcggctacg

SEQ ID NO: 332505 - DNA, 2797 bp, Homo sapiens
gtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacatgatgatgctgcctctcctctctgtgttgtctgggcccttgtttacaagcacgcgttacccttcctgaggggagccatgctctagcccctggagggcctgttgcaggggcagggcgggcccgttgcctttggcagctcctggagagctgtggacatgcagtccccctcagttcgtgctgcaataaaggccatcttctcttaaaaaaaaaaaaaaaaaaaattttgggggccggcgccaaaagttttaacccttggggggggccagtggaaggcaggcccagagaagcggggagggggggttccccaaaaaaccggggcgggttgaacccggggtgggtggttaaaaggcggctacg

SEQ ID NO: 332506 - DNA, 2092 bp, Homo sapiens
gtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgaggggcagggcgggcccgttgcctttggcagctcctggagagctgtggacatgcagtccccctcagttcgtgctgcaataaaggccatcttctctta

SEQ ID NO: 332507 - DNA, 3394 bp, Homo sapiens
aagagaagatggcctttattgcagcacgaactgagggggactgcatgtccacagctctccaggagctgccaaaggcgacgggcccgccctgcccctgcaacaggccctccaggggctagagcatggctcccctcaggaagggtaacgcgtgcttgtaaacaagggcccagacaacacagagaggagaggcagcatcatcaggtgcagctttgctacaagaaagatagttcttaatttcaaagaggagacaccgctacacctagccctgccctcccatgcactggaaggctctggaagtagctctcgcctgcctgggcagttaggtccacccactgcccgtgagctgggcccaggcacactgcagccacacaaaaacgctggcagctgactcctaatttcagaaacacaattagaaaagaactggaattttacatttttctcccatacattaaaaaataagaaaaagccaacattttgactgtagaccctggtaggtggcatctgactttaacctgaagttctcattggaatccttttctgtctggcgctccaccgcccacaatcagccccagccccaggatccttcggcaaggggcgcctggggctggggctcattggaatccttttctgtctggcgctccaccgcccacaatcagccccagccccaggcgccccttgccgaaggatcctggcccatctcacacaagggcgggaccccgtggagtgcccggcgagcagggcaaccactgggaagacagatactgatttccctgttggggtctgtgaccctcagcaaacgaaaaggaaacggtaacaagacggtggcctcctgccaggacctcagcaggaggtttgctggtgaaggttctgggtgagctggaatgggtgataaggcgggcttgctgggtggtggcctcaggctgttcctgggcccctgtcgcatagagccctgtgggtgcagtgtggggccccacagccgtcccggggtcgtcctgatgcataagagcagagaccccggaagagaaacccgcctgccccgtgtgatacagggctcccaaacgcttcccggtggaaccctgctcccgaggacaccttgtctcgctccacggaacccttcccccagcaccccctggaaacacagcagccaggaacaaattctccatgccaggaacgaagcccttggctaaactggagactcatcagtgcacagatggtggtgaggggtgagggcagggcgtggggtggtgctcagccctggggacaccatcactgtcctgctctgacccacaggtgagaggaggatgctgtgctcccggagtgtggcgccgggaggatggctcggcaggacagaggcctggggctgaggctatgcccagggccggtgtggggagggacatgggggcctttgcagaagcagctcagagaactgaggttggaatcctgccccaagcacaggttttggggacagcgagtgcctagacaaggcaggtaacgtggcagccaccgggctggtccagaaacaaggtgctgaagacgtcgttgaagaaggtggggtggtacctgcaggctcgctcacagtcggggttgaagttcacctccaggatctgcggctgcatcacccgccttccatctgggccgttgtcccacttcagcatgaggtcgacggcatacatggcccgggatgaggggtagtcgcagaggcccaggggtggtggcttggcacaggccacctggaacagctccgtgaaggcccggaagatctcagcctggacgtccgtccagggaaattctgggtattgcttctcaaactcggggatgaactcttcacagtgcacctgcttcagcaccacatccgggtcatagttcatgaccgtgaagtgcttctcgtagtcatccaggtcgttgagtgcaaaggcccggttggagaaccgcagccagaacacatcatacacgaacaaccgtaggggcctcactgaccgcagcagcacgatgtagcggatgtcgaacttgacctttcccacgtcttctcgaaggaacaacacgggactttcgatgtacttggacacaaccttgggggtgctctctcggtgccggatgatgctgtgcaggctcttggtgacgtgggtgtccaggctgcgcgccaggttccagggcttgcagatccagtggttgtcctcgccccacctttcccgctgctggaagtagctgacaaactggggcagctcagtgcgcaggttgaaggttcggggcagccagggtgggccctcggggccacctgcccggcgcgcgatggaggccaggcagtccttgacagtcagcaggttctcgcaggggaactggttcagcagcacgcctggcctctcctggctgagtttcctgtagtccttgaagtgtgagaagttgaagaggatgtcggcgtccgcctcactctgggtgagggtgaagcgcgggtgggtgaggctgctggccacctgctgcacgtccgtgtagaccttgaagatgtggccgtgggggtgcaccacggggttgatgtcaagtggcagcttctccttgttttcctccagaatggcctggtagtgctcggcgggcggctcgggtgtgcaagagctgaggtccagcatgtcggtgggggcccagggcagcagcatgcacttccggatcagggggtccgtctctccgtaggcaaagtctcgggtcacctcctcgccagtgtccaggtccctcaggggccacagcagcgtgtaggccacctgctgcggcatgtagaagaagggtgccgtggcgaagctgggcacgtccgcgtgctggatccgcgaaccgaactcgtccatgatataccacaccggcatcttctcctcagctgtcccatgggccagctggtaggtctggttgaacttccacatctcctccagcaccagggccacagcctctgtactgggcagctcaccgtggaactcaatgcccatcaggttggccatgcggtgcagcagcccgggcacctgctgcagctgctggcgcgcgtgctccacacggcacgtccaggcgtggtcgatgaggaagatgctgttggggtgggctgcctggagcccgctctccctggtcacgatgaccttgtagcacagctcgttccccgggttgggctgctgcttccgcacctcccgggctgcctcgtcctcctcctcttctacctcctccacttgcatgatcccaaacacttccccagcgtcgaaaacctcgtgctccagcttgtgcaggaggcggccccagtaacgttcggggacccccgaagcgcgcagcgccgggccgtgcagcgccgcgaactcggccaaggcctgcgcgccctcctccggcgtctggcccgggctgctacgctccgcaggccggcgctcgggac

SEQ ID NO: 332508 - DNA, 433 bp, Homo sapiens
ataaactccggaaaaccattggccgcctggcaagtcaagtgcaagaacgcggcaggtggctggagagtctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacatgatgatgctgcctctcctctctgtgttgtctgggcccttgtttacaagcacgcgttacccttcctgaggggagccatgctctagcccctggagggcctgttgcaggggcagggcgggcccgttgcctttggcagctcctggagagctgtggacatgcagtccccctcagttcgtgctgcaataaaggccatcttctctta

SEQ ID NO: 332509 - DNA, 591 bp, Homo sapiens
gtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctttggcaaaccccggccaatggccccaaaaaccgtgggaattggggggccactttggaacgcttccaacggtggaagctgccagtaccagaggctgtggccctggtgctggaagcggaaacgcacttgtgcg

SEQ ID NO: 332510 - DNA, 3329 bp, Homo sapiens
acccctgctgacgggaactctggcccccaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggcttcgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacatgatgatgctgcctctcctctctgtgttgtctgggcccttgtttacaagcacgcgttacccttcctgaggggagccatgctctagcccctggagggcctgttgcaggggcagggcgggcccgttgcctttggcagctcctggagagctgtggacatgcagtccccctcagttcgtgctgcaataaaggccatcttctcttaaaaaaaaaaaaaaaaaaaattttgggggccggcgccaaaagttttaacccttggggggggccagtggaaggcaggcccagagaagcggggagggggggttccccaaaaaaccggggcgggttgaacccggggtgggtggttaaaaggcggctacg

SEQ ID NO: 332511 - DNA, 2007 bp, Homo sapiens
gactggcacacaggccagtcccaggagccgcctcctgagttcctgctatggaaggcgattgttagcgctgccatcatgagccaggctgggttctgtgttgtctcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggcttcgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacatgatgatgctgcctctcctctctgtgttgtctgggcccttgtttacaagcacgcgttacccttcctgaggggagccatgctctagcccctggagggcctgttgcaggggcagggcgggcccgttgcctttggcagctcctggagagctgtggacatgcagtccccctcagttcgtgctgcaataaaggccatcttctcttaaaaaaaaaaaaaaaaaaaattttgggggccggcgccaaaagttttaacccttggggggggccagtggaaggcaggcccagagaagcggggagggggggttccccaaaaaaccggggcgggttgaacccggggtgggtggttaaaaggcggctacg

SEQ ID NO: 332512 - DNA, 751 bp, Homo sapiens
aaaacgttgcataatttttttcctctttaaagtgtatcttatggatgaaggagtggtgaagtcagatgtacataaagtactgtacatgagttacttccgattcccttgtccttctgtgtgtttactgtggagttctcctcaggacagatgactggcagactccacgctgtgatattaatgaaaccagtggtggaagatgcatatgccacatcttgtccctgcttcttccttagttatttggtcccctcctcctcccagcaggattagggtaggaactgagtggaagggcaggagactgaatttaagaggcaatctaaagttagtgttgattctggagatggaacagagttgcagtagactgaggttggcagccttctgtatacctgctgccattttaattccagcatttggaatagggccttcagattccaaaagctaaaatgttagcaacagtcgcttttgtggaattctttccccctcacctcccctcccttctcctcccctgtcctctcctcttttccttcctttcgacagagtcttgctctgtcaacaggctggagttcagtggtgcgatcttggctcactgcaacctccgcctcctgggttcaagcgattcccctgcctcagcttcccgagtagctgggactacaggcgcatgccaccatgcctggctaatttttttttttttttttgtattttagtagagacgggttttcaccatattggccaggatggtcttaatctctcgacc

SEQ ID NO: 332513 - DNA, 303 bp, Homo sapiens
tctataacagtttttatagattttggagtgtcctgaaaaatttccttgtattgctggatccagtaaagttgtctaggaacaatatttcacaaaaaaattataattgaatggtgacattacttacaaaatgattttggtcagtttatgtgtctctgagtttgaaaaattttgtgacagaatgtcttgtagagttactgctaataaaagaatgaaatagatttgttcctttttccccccttgtcttcaaaagttaagagacctaaatcaaatgtcaatataaaataactcctagggctaagaaaa

SEQ ID NO: 332514 - DNA, 2582 bp, Homo sapiens
  misc_feature (613)..(613): n is a, c, g, or t
  misc_feature (2290)..(2290): n is a, c, g, or t
atttacagatagattagataatctatctagagatagatagggagagatatctatcaatacatatctctatctagatatagatagatggttttctatatagacctatctatctatatatgtatacatctatatatgtctacacatatctctatacacatatatatatttatatctacatctatatttctacatgtatataggtatgtatatatctacatgtatatatgtatatagatagatatatacataggtatctgtatatatgcatatacatgcctatctatctttatctacatgtattacatagatagggtaattactgataaatcctttggccttctttgtaaatctctgggctaaagacccctccagtattatacatgttctggtctagattgctcactcaccagttctcctcactatctagagaagatccacttagcaggcctccccttaaagaagggcaccttaactggactcactcctcccatagtagactgcacagtacacaagcagaagaggagagctcaataataaagtcaccataaaggataatttttaaatgaataaagaaatcagaaaatccagtattggctagcacatatggctatcngcaagctcaccctacaaaaaaatagtgagaaaacagttcgaatattggccgtttggggcacatattctacaaaaaggaaaagttttgaaatgtatatatatttaatttaactctaaaatatttgtaaggcaagcccagtggctcacacctataatttcagaactttgggaggccagggcaggaggatcgcttgaggccaggagaccagcctgggcaacatggcaagaccccatatctacagatggttttaaaaaattagccaggtataacacgatgaaaccccgtctctactaaaaatataaaaattagccgggcatggtggtgggcgcctgtagtcccagctactcgggaggctgaggcaggagaatggcatgaacccgggaggcagagcttgcagtgagccaagatcatgccactgcactccagcctgggcaacagagcggagactccatctcaaaaaaaaaaaaaagaaaattagccaggtatggtggcacacacttgtggtcccgtctatttaggaggttggggcaggagaattgcttgagcccaggagtttgaggctgcagtgagctatgatcatgccactgcactctagcctgggtgatagaacaagaccctgtctcttaaaaaaaaaaaaaaattgtattatgcaccaggtacaatgtgctaggtactggggagagatcttaaaaaaatgtattatacaccaggtacaatgtgctaggtgctggggagagatcaggggataaagcagaccaaaatttctgtcctcatggagcttgtggtctaaaggaggaaaaaaggcaataaacaaattaaaaaagaggaatacaaagtatgtgggtagggatgagtacaacagaggaaaatcaagcaggaaagatagaactctggaaagaagtagggccagtgtcaaacaggatggccagggaaggccacagtgagaaggtgacaccaaagcaaagacctacaggaggtgaagtggtgagccattcaggtcactaaaggaggcatgttcccaggagaggggacgacaatgcaaaggcaagaaggagcaccagcgtgtgtgttgagaaaagcatggggacccaagcagctaaagtggaacacatgtaagaagaataaccgtaatgaggtctgagagacaactgggtgggaagtgtcttaatctgtttgtgttactataaaggaatatctgagtctgggtaatttataaagaaaaggaggtttgtttaggtcacaattctataggctgtacaaaaatcagcaccagtatctacatcaggtaaaggctggaggttgcttccactcatggcaaaaggggaaggggagccagtgtgtgcagagatcacagggtgagagaggaagcaagagagagagggaagcaccgggctcttttaaaaaaccagctcttgggaaaactaatagagaactcactcactactctcaccatggcagggcattaatctatttatgagggatccatccttatgatccaaacacctcccactaaacccgacttccaacactggggatcagatttcaacatgagatttgaagcggacaaatatctaaactacagcaaagagtacagatcgggaggcatggcaagctctgctggtcactccaatggagtcaacatttcaagaatgttacaagcagctgggttggtggctnatgcctataatcccagcactttaaaaggctgaagtagaaggatcacttgaggccaggaattcaagaccagcctgggcaacataaagagaccctgtctctaccaacaatttaaaaaaaaaaaaaaaaaaaaaaaaagccaggcatggcagcgagcacctgttgtcctaggttctcaggagcctgaggcaggaagattacttgagcccagggggttgaggctgcagtgggccacaactgccccactgcactacagcctgaacaacaaagtgagatcctgtctcttaaaaaaatt

SEQ ID NO: 332515 - DNA, 1468 bp, Homo sapiens
  misc_feature (613)..(613): n is a, c, g, or t
atttacagatagattagataatctatctagagatagatagggagagatatctatcaatacatatctctatctagatatagatagatggttttctatatagacctatctatctatatatgtatacatctatatatgtctacacatatctctatacacatatatatatttatatctacatctatatttctacatgtatataggtatgtatatatctacatgtatatatgtatatagatagatatatacataggtatctgtatatatgcatatacatgcctatctatctttatctacatgtattacatagatagggtaattactgataaatcctttggccttctttgtaaatctctgggctaaagacccctccagtattatacatgttctggtctagattgctcactcaccagttctcctcactatctagagaagatccacttagcaggcctccccttaaagaagggcaccttaactggactcactcctcccatagtagactgcacagtacacaagcagaagaggagagctcaataataaagtcaccataaaggataatttttaaatgaataaagaaatcagaaaatccagtattggctagcacatatggctatcngcaagctcaccctacaaaaaaatagtgagaaaacagttcgaatattggccgtttggggcacatattctacaaaaaggaaaagttttgaaatgtatatatatttaatttaactctaaaatatttgtaaggcaagcccagtggctcacacctataatttcagaactttgggaggccagggcaggaggatcgcttgaggccaggagaccagcctgggcaacatggcaagaccccatatctacagatggttttaaaaaattagccaggtataacacgatgaaaccccgtctctactaaaaatataaaaattagccgggcatggtggtgggcgcctgtagtcccagctactcgggaggctgaggcaggagaatggcatgaacccgggaggcagagcttgcagtgagccaagatcatgccactgcactccagcctgggcaacagagcggagactccatctcaaaaaaaaaaaaaagaaaattagccaggtatggtggcacacacttgtggtcccgtctatttaggaggttggggcaggagaattgcttgagcccaggagtttgaggctgcagtgagctatgatcatgccactgcactctagcctgggtgatagaacaagaccctgtctcttaaaaaaaaaaaaaaattgtattatgcaccaggtacaatgtgctaggtactggggagagatcttaaaaaaatgtattatacaccaggtacaatgtgcttcaacgctttatacttctcaacgctttatacttcctcaacgctttatacgctcaacgctttatacttcctcctcaacgctttatacttctcaacgctttatacttctcaacgctttatacttcattatcctaa

SEQ ID NO: 332516 - DNA, 126 bp, Homo sapiens
cagaaagacaaatgtcacagcttacctaacatcatctaccagacaaattgtttatatttaacggaatcaggcagcttccactgagggcttttgtgttccatcttttttgtcattgtattttaaact

SEQ ID NO: 332517 - DNA, 474 bp, Homo sapiens
atttacttaagaaaatacttacatattgtttttgaaaaatatgtcatgagctagaaggagaaagttaatgatataaagtgtattaaaagattgccttcatgcagaagattggtgaatgttaatttgcataagtcaatatggcatccgtgaaaatatgatgctcacatctgcttcaagaaaatctgctgagggggcatacttgactggtggcctccagctgctgtcccgcagacctaacatggcatttgctccaaggccatgcttccttggggctgctcccagccagggactgagcacaaggtggttgctagagcagatgcattcctgcttgattgtgattgctttcatgggcaattttggctcagggacttttcatcagcctggttgaatctttcttagaactgctccgtggtctgaagctctttctacctaatccttcctctctcatcccctttcagagatgtcaaatctgca

SEQ ID NO: 332518 - DNA, 172 bp, Homo sapiens
ttgtggggacaaaacggtaaaatgctgctgaaaagtttagaccagtgacggctccaatcagcttccaggaaatggcagtaaatggtggaacacgtaagaggtctggtggcaagcggacaagagatgagtccgtcaacccccacagagagagcgtaccccacagagagagcgt

SEQ ID NO: 332519 - DNA, 357 bp, Homo sapiens
cttgtgatctgcctgcctcagcctcccaaagtgctgggattacaggcgtgagccaccgcgcccggccctgtctcctgagttctaacctcaaatgtccaactactttctctacaattccatgtgggtgactaatacatatctcaaactcatctcaaagcaaacttctcccctgccctccaaacatgttccctcctgtggtcttctccatctcagttaatggcagctcttattactctagttgattaggtcaaaacccacagagccatccccttcacatcacttccttcacacccgtacctgtcagcaaattccgtctgcacaaccatatcctctcaccttggcccagtcaccatcgcc

SEQ ID NO: 332520 - DNA, 1727 bp, Homo sapiens
ctgggagcggaggcaggcgggcagcggcgggggaggcagctgggagcggcgccaccccggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcataatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaaaaaaaaa

SEQ ID NO: 332521 - DNA, 480 bp, Homo sapiens
ttagagttgtcactgaattctataaaggggttctaagatccagagagtagccatcgaattttgatggaaaaattcttgaaagccaatttaaagggctctataggtgtgtatctttgtgcgcatcttcacacactgttttaggaagcagggtaacatcttggtcattggtgaggacctgagctctctctcctcctccctgggccaggacgctgcagaggagtcctgcgcactcatctgtcaggtcttccagatcatctacggggaccagagtattgagtgtgtggaccgggctggctaccactacacatccacacctgaacggccatggctctgcagccgcagtgagtaccagaactcctggcctcccctcctgtgaaacatcccaaaaaggccaggggagggaagatgtcccaggacttgggctgatgaaggtatttagggctcctgatctctgccataattacagtgtaccccacaatt

SEQ ID NO: 332522 - DNA, 1791 bp, Homo sapiens
ctgggagcggaggcaggcgggcagcggcgggggaggcagctgggagcggcgccaccccggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcagtgagagctgccacacagatgggacgtatgcctatgatgccgacttcagctgctgcagctcctttaatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaaaaaaaaa

SEQ ID NO: 332523 - DNA, 405 bp, Homo sapiens
acaacaccaattttacacaatctcctccaaaaaatagaagcagaggaaacacttctcaattcatttcatgaggccaatattatgagacgaaataaaaagaaagaaaattacagaccagtatctcttattaattctgatgcaaaaatccttgacaaaatataagcaagccaaatccaacaatgcataaaaataattattcaccattatcaagttagatttattacagctatggtagttcaacattcaaaaatcaatcaatccaccatatcaacaagccaaggaaagaaaagcatataatcatatgaattgatgcaaaaagaaagcatttgacaaaatccaaaactcattaagtctcccagcaagtcataaatagtgcaaaattatttcaacttgataaagaacatg

SEQ ID NO: 332524 - DNA, 527 bp, Homo sapiens
tggggtaagggtgattaggttttaatgagatggtaaggggtgcacgatcggtcgccaaggagggagtagaggtatcttatacttgtgggctaaggtggggggatacaagaggaggacgcaaaggaggctttggattgggaagaagggcggcaatgagatatagatgtagtccaggaatagtcagggaagcagataatttagttaaagtgtctcagcctaataagggaactgggcaggtggggataactaaaaaggagtgcttaaaagagtattgtctaagttggcaccagagttggggagttttaagaggtttagaagcctggccgtcaatacccacaacagttatggaggcaagggaaacaggcccttgaaaagaaggtaatgtggagtgggtagcctccgtattgattaagaaggggacggacttaccctccaccgtgagagttacctaaagctcggcatccgtgatggtctacggggcttctgaggcgatcaggcagcatcagtcttcagccggtaagtcaaga

SEQ ID NO: 332525 - DNA, 245 bp, Homo sapiens
cccaggagttcaagaccagcttaggcaacatggtgagactctctacaaaaaattaaaaaaaaaaaaaaattagccagccgtggtggaatacgcctgttgtctcagcttctcagaaggctgaggtggcgaatacgcctgttgtcccagcttctcagaaggctgaggtggcaggattgcttgagcgtgggaggtcaaggctgcagagggccatgatcatgccactgcgctccaacctgggtgacaga

SEQ ID NO: 332526 - DNA, 788 bp, Homo sapiens
ggcattctatacatcctcaggttgcaaagtggctgcaggacttatattccatttcaatggaagttagatactaaaagggagaaataaaagaacaaaacctgtaatttacatatccaagctatgcaagagaccaagattattaaagcagggcgcacaatgctcctcagcccctggatttaaagtgggggtgaaaagcatttatagataagaatttgaaattcaaatgaaggaacaagtagtctgtctaaaatgctggcctccgcagatactgaccttccgtacaaaaggtagcggatttttattttcaggcactaaagaaaagagaatgaattgtgtgtcgtgcactcagattagtgataacgataaaacgtagcaaaccttttgatgcttggtgcctaattgaaggaaatagaggagagtggtaaagtaaggagtgaacatagccaggagaataattaacagcttcatcaggcaaaacttaccattcgtatgtgtatctaacacacgctaatgtcagttggattgagacttgatgtggagcaaatttctttaaaagataatgaattgccgctcttcgaggaacaatttgaaatgcgtcaatgtcacccttatttataacaccactagggaatggcaggaaagttgagatctaaacattttatttctctaaacaggagtcatgatgacgtggacctcattagagttatcactccacctgtggaaactaaaacagataagattgatataagcacctagggatttatagacgtaatacctattatcactaa

SEQ ID NO: 332527 - DNA, 176 bp, Homo sapiens
acaacttgagtaatgggaggggtagtggagaggaagaggggctgaacagacgtcagcagggtgcaaggggaggatgggttgcctaggaaaccaaacagtaaagaatgagcggaaaaatcattagctgaaaaacctctgaaatgcttttacaagagctcaatccttcatcccaaaag

SEQ ID NO: 332528 - DNA, 1028 bp, Homo sapiens
gttgttagatgtaataaaaatgtgggaagggcatgctggctgatcgaatcagtatctgaagagaacttgagtggatagaatgctggaattactgaaataaaatgtactaggtttgcaaaaccaatagcatgcacatgtgttgggctgaggttcatgtgtcagagactcagttgtagaaggaactttgaatctggcaggcacttaactgtggctgctcagaactaatgtatctggggctgcttgagcaggggctgaggtcagaggcagggagtgagctctccatcatccttgactcagacccagctccgcaggagctccatggtcatccctggagctcatgtggagtgcaaggtccgggagtgggggcgctgacagaaacaaatctggggggatcagccaggtcagcaggggacagagatcatgtcttttagaagaatgtgggcttcctgacctatagaagggcagctgttcaccccctgcagatgatagcagggatgatctggggcctcaggagcgcctttctgttgttggcccaataattcaaagacaggaactgggcagtgcccttaatatctgcgaagacttccacattcagtgtctcttacaaggagtgagttccaggatacagggggtatctaaggccaggtatggtggcgtgcattggtagtctcaactacttaggaggctgagcccaggagttccaggctgcagtgagctgtgattgcccctaagaaagccactgcactccagccagggcagcatagtaagaacctatctctaaaaaaaaaaaaaaagaaaagaaaagaaaagaaagaaaaagaggtatctaaggagtctgtcacaaaatcctccttattttcagtcttagaatttgcaaggagggttacatctgtgctatgtaagtccccttcaatgtaagcatgttcatttcccaaaagggccttactcatttagaaaactttaaagtaaacaagggaggaagctagtgcttcattaatcagtataaagtaatgttgcttcattgagca

SEQ ID NO: 332529 - DNA, 589 bp, Homo sapiens
aggttgttttctgtcagtaactcgggagtgctgtggcctttctgttgagcatgctctgtagtccacacgtttccacatagtggtgttttctttgcacagttttgtaggaagactttatgagtgctgtaactctactcccctttttgctctcataagaagcattataaaatgttaacttatgttattcacagggcatgtaaggagatgggaaggaatagaggtatcagtacatatgtccatgctcctccatagattttcttctggttggtagaaatgttgagcttttcattcctaaacattgaacattgaatgtgcaaggtgaattcctagaaacttgaatgcagtcttaaaagccaaatgataacattggtttttccaaaaatgttacacatttagaaaagagtcccccttcccctcttctctttgcccacattcctaagacaagtaaggccaggaaaaaggattgatcctggtgtcataaaatatgagtgaaaatttcaaagtcctttgttagcttaatcttttcagttttgtagagtttgaatagaccaactgatacttaaataactcagtattagaaatgacaggt

SEQ ID NO: 332530 - DNA, 453 bp, Homo sapiens
gccctccctgtcactctcccaccacagcatcccaatttctccaactcttcactgcaagcctggaagccaggcactctccaaaggtcacaataaagattggcaatcaaatgtccacagaggataagcaggcaacataagtgactgggacaagtcacccgaaacacacagcactctccatctaccaaacgttttccagaacacagccacatgaaatcttttccttttcttcactctgccacaaggcaagcaagaggacaaatggcaactaacatatcctgggaactggagaaaattcccagctgtataagtagggcagccactcatcaagcaaacggctgctctgcagaacaactctgtgtcccagggtgccagctccttccatttccccagaaaaagaaatcttaatctttatgttaaatctccctcacaagcattggcaactaatttaacagc

SEQ ID NO: 332531 - DNA, 423 bp, Homo sapiens
aaataaatgctagctaccatttggtgacatggatcctgactagggccaagtgctattccagggccttcccagcactaacccacacaccctccacaaggacttcatgaagtcctcactcttttttttattttcattttttttttttgagatggagtcttgctctgtcatccagcctggagtgcaatagtgccatcttggctcactgcaacctccgcctcccgggttcaagtgattgttttgcctcagcctcctgagtagctgggattacaggcgcgcaccaccacgcccagctaatttttgtatttttagtagagacggggtttcaccatgttggtcaagctggtctcgaacttctgacctcgtgatctgcctgcctcggcctcccaaagtgttgggattacaggcttgagtcacggcgcccag

SEQ ID NO: 332532 - DNA, 535 bp, Homo sapiens
tgctcacttcccgagagcactctgtatgcccactgcagtgtttgaagccgcacacatgtgttctctggaacatcgcaccactccagcaaggtggctgtgggtatgtccattgtacagatgagaaaactttgagtcgtgccaggtgaaatgacttgttccttgtcaaagctagagagtggcagagtgggcatgtgacctcaggtctctttggcttccaagatcaccactgggttccaccactagagtctcgtgttgcacccagctttggaaagggaattctaaaagccaagataccctggaatcagactggagcagataaacctcatggcttttgggggggacttggagctttctcttgtcaggattcagagttgggtcactgctttgagcacgtgttgcgtatttgtatctgcatgtttaggtatttgcacgtgtacgtacaagttaaagaagggatttggatactggagggtctgtatcactggcaagtgattccagggaggccttgtgggcaggtgtaaagagtcatcccagg

SEQ ID NO: 332533 - DNA, 137 bp, Homo sapiens
gtgcatagcgtcacatcatgtagttccaaccttacagatatcaatcctactttatctgagggatagggggctgtggtggctatgaaaatgcaccacccaatttcctgttgcagagagtctcattgcacccagatcct

SEQ ID NO: 332534 - DNA, 504 bp, Homo sapiens
tttctattggtctatcttccattccagagattctttatatagccatgtgaatgtgtgtttgttttttatttggtttttgtttttatctttacatttaagtttaggaagtttctatttgtctatattccatcccaaagattctcttccaggtttgtaaatgtcagcagtgactctgaagtcacctgtctctcaggatttcagaatgactatttacctgtgttctcagtttctaaagggtacagataaatgagttttgtattattccattcttgcattgctataaaaagaaaacctgagactgggtaatttataaataaaaggtttaattggttcacagtttggcaggctataccagaagcatagcagcttttggggaggcctcgggaaacttagaatcatgatggaaggcaaagcagctggtgtcttcatgtggccaaagcaggaagacgagaaagaggaaggaggtgctacccacttttaaacaaccaggactcgtgagaactc

SEQ ID NO: 332535 - DNA, 447 bp, Homo sapiens
attaagatctgaagctgggaaacttccttccagaccttggctcttcttgaaggcttctgttttccatgtggctcttaggaaggcccagagaatgcttgcttagcaacctgccgcaaccccagaagatctgagtttagaaggggagcggaatccatccacagtggagctgatttgcatgacagggcttgtcattgctgaggacctggggagtcaccactcccgaccctgcaaggtccttgctgtgtgactttgcgcagctgactggagcttcacaatttcctaggatatggggcctatgtttattctccctgacttccagccagtcacaacatgttgtttaccccttgtggagtttgacgttgtattgttttttctttttcttttttttttttttaattttagtttaagttctgggatacatgtgcagaacgtgcaggtttgttacat

SEQ ID NO: 332536 - DNA, 567 bp, Homo sapiens
ggggtctgcagctggcccgtggacatgcgatggcacttacattcttctggtttgcttgaggccacatatagaaaagtatctataaagccctcatgttaatgtctcacatgtagagccaggtggccttttgagcttaggtagctttgtgcctatttatcgtctgggctttcaaaaagagtttgtggaataggtatatatgagaggtacatgtatttcctggatggacagaagccgtgactccctgtttagtatggagccaggcaagtctggcactcagtattcagtttagcacttcctgcacacaggcaggctcatctagtctccagcccagccctacaagcccctcacatgcccagaatgccagtgggaaactaacactctgggaattgcctataagcctgtagactccatagcctcctgccacagctgagtgtgagtgtggacctcagcagctgaggaactctgctccaaggctttgcttggtggagttcagcagcaaaaccctatgtgacagcctgtcctgtcaaaaacttgctcctgctcccacacaagctgccttttttttct

SEQ ID NO: 332537 - DNA, 199 bp, Homo sapiens
ccatgtttactaagaggcagatgccattttatgccaatgccaggacccgagagaaatcatacttgaataagacgccttcccctctccttttctccttccccagtcgcttctccagatattgcacccgctcctaattcgcgccctttgtgttactgtactatatttgacactttacttgatagttccttagtggcaaaaa

SEQ ID NO: 332538 - DNA, 231 bp, Homo sapiens
attgactagggagtcctttccctattgcttcttttgtcaactctgtcagaggttagatggttgtaggtgtgcggccttatttctgggctctctattctgttccattggtctgtgtatctgtttttgtccagtaccatgctgttttggttactgtagccctgtaagtatagtttaaagtcggtagtgtgatgcctctggttttgttttttgttgttgttttgttgttgttgt

SEQ ID NO: 332539 - DNA, 464 bp, Homo sapiens
aaggcagccaatagagatgagttaaactaagcaggaaagaaaatggtcaaagatggatctggaggaataggtagctacgagcacatgtaagtcctcatagattatattaaggatttgaactatctcctaagagagtttaaatttggattttcatttttaaaagggcattctcagtacctattgagtataatgttcactatttaggtaatggatatccaaatagaagcccaatccccagcagtacataatatgcccatatagcaacatgcacatgtactccctgaatctaaaatgaaacaagatttaagaagtaaagaataaataaataaaaagggcatcctggctgccaagtgaacaaagagcctgaagtgatgctacaagagtaagcatgaggttaaagggtcctgatgcctggctaagataaggatcatgctaggagctatgaagagtgatggagtgagtac

SEQ ID NO: 332540 - DNA, 374 bp, Homo sapiens
acgctgctaaggggattctaggctgtgtcgtagcaattccctgctcttaacagtgtggaggatttctaaggcgctacagtgctaaactagattttcgtatcctaatttatatgaagggaccataaagcattagttgaaataaataggtttttcattaagcaaataactgatagtaatatacgagattttcagaatgatatctgatgtgaattagccacataaaatttttggtggcttggccttggaagtcagatttttttttctctaatatggaaaaagaacattcatgggaattaaaaggtcactgtagttgaattctcagttgtatagattgtcccacttgttaaccactcagcagacattagctgagtgct

SEQ ID NO: 332541 - DNA, 168 bp, Homo sapiens
tgtttggcagtgagacaacaccatctctgtgctgatccagctggccctcaactgatatgccattccatggggcaaaacagccagaggagtcagcactttctccttaacctcttgcatataccaacacagaaagtgattaaaggcttgactgttactttcattttggct

SEQ ID NO: 332542 - DNA, 866 bp, Homo sapiens
tatctcctattgtggtagcatagggactctctggaatacccttatctcttctagagatttgtattgaatgtcaccaaaagtacttttctacgtagtatttcattatgagatcagttggtcctcaggtattgttgctattcccgttttacacgaaaggaatctaatgtttaacagtcatcttaaatgacttgctcccagtcacacagctcattagcggcagagctgggataagcagccaggtctcacaaagtcctaacccagtgttctactacacaacactctctcaaaattattgggaattattttaggctcatccaaaatgaccagaatggaatgagttatttctgtcccttcttaactccaccacattatcttgggctactttataaactgtgccttaaatgaaaaatactactctttcccgcaggataaccagcagctgtctgccagcacaaagatacttcttccaagaatctttgggagctggcgagatgtatacatggtcaaaccaggatttctagttgataatagtatgaccataatccagacaatagactacaatccaagtcttcccagcaacgtctttcctatttaacctgttttggtttttttgagatggggtcttgctctgttgcccaggctggagagcagtggtacgatcttggctcactgcagcctcgacctcctggtctcaagcaatcctcccacctcagcttcccgagtagctgggactatgagcgtgcgccaccacacctggctaacttttgtagagacagggtctcgcaatgttgcccagactggtcttgaactcttggctttaagtgatactcccactttggcctccaaaagtgctgggattacaagca

SEQ ID NO: 332543 - DNA, 128 bp, Homo sapiens
acaagagctgaggacatattctagcccccaagaagtgctggagtattcccactcctcagcaatttttacttttgtctacccagtattggtaaaaagtacctgtggtgtcaaaactcttgagatacaaa

SEQ ID NO: 332544 - DNA, 299 bp, Homo sapiens
gcggccgcctactactactactactactaattcgcggccgcgtcgaccagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttct

SEQ ID NO: 332545 - DNA, 6867 bp, Homo sapiens
tgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccagctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaaatttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattctt

SEQ ID NO: 332546 - DNA, 6813 bp, Homo sapiens
tgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccagctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctattctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattctt

SEQ ID NO: 332547 - DNA, 6372 bp, Homo sapiens
  misc_feature (6371)..(6371): n is a, c, g, or t
tgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccagctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtggggatacaggggtttccatattcagatcagcagcagtagcagagggagagtgacagactcagagctctggggacaccatgcccttgcagctggaggggaactggctctgggccatctctcggcacatgcatgcacccang

SEQ ID NO: 332548 - DNA, 5214 bp, Homo sapiens
tccagattatgcacctactgttccgacccacctatctaaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaaatttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattctt

SEQ ID NO: 332549 - DNA, 4006 bp, Homo sapiens
aagcagtggtatcaacgcagagtgcccattacggccggggcctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaaatttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattctt

SEQ ID NO: 332550 - DNA, 2771 bp, Homo sapiens
gaatatactaactagagatctgtctgaagccgtgtgcagcgtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaaatttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattctt

SEQ ID NO: 332551 - DNA, 2061 bp, Homo sapiens
tctagaggagtccccatacatgctcgaaagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaaatttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattctt

SEQ ID NO: 332552 - DNA, 1343 bp, Homo sapiens
tgattgattgagacagagtctcacttggtcgcccaggctggagtgcagtggtacaatctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaaatttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattctt

SEQ ID NO: 332553 - DNA, 362 bp, Homo sapiens
ctcagaggatcccacaaccatagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattctt

SEQ ID NO: 332554 - DNA, 176 bp, Homo sapiens
agataatgagcttgaactttataagaccaaggtattctcttctgcttccttttcattaatcttttatataataaaagacatgaaaaccaagaactttaatttgatataggagggtcagttgtataaatgaactctactttaaaatagatttatttgaggttagtggaaagcatttt

SEQ ID NO: 332555 - DNA, 431 bp, Homo sapiens
ttaatataaaggcaattaacatatttttgtgttttttaaacataatctagttgaggaagaggatggcaagactgcaactcaaccactgttgaaaaaaggcaggcatttttcatcattttattttaaaccctttttcatactgtaaactctttaactccaaccttattcccttttttttaaccttggttttatttccatggtgaggtaatgttacagttctataatgcagattagaaaaattattattagtctaactaaaaagttaaatattctcaggaaatggagttatatcacaaattcttttctattatcacagcatttctgaaatattagacccagacagccggtattaattttttttaatttaaactgcatggtttagatgataagtagggacactgaaataggttttatttgcagtgtcacttgca

SEQ ID NO: 332556 - DNA, 5907 bp, Homo sapiens
tgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccagctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttct

SEQ ID NO: 332557 - DNA, 4199 bp, Homo sapiens
tgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccagctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtca

SEQ ID NO: 332558 - DNA, 3948 bp, Homo sapiens
tagcttatctatattctcaaacaccaaaaggaaaagttgaatcttgctctctttggtatactaatgtagtggtatgctaagctggctcataccaacttagaaaagctgattgtaaaattttcattttgacagctggttattaaatgcagccattattaaaaatcaaatacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaaatttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattctt

SEQ ID NO: 332559 - DNA, 2550 bp, Homo sapiens
tcctcgttaatttccaccaggaggaggcgcgcagcccagctcccctagtctctcttcttaaatccccctacctacggctgccgaggttggccgcgcgtcgggagtctccccgacagtcctggccctcccccgccccccgggttggtttttcccagctgcggaggttgggaggttgggccaggggctggggtgcgaagagagtcggcgcccgcaacgcggagccgggaagtcgtcgctactctggtggaactcagagttggttctggaggcggcggacgcggaggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacaaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgact

SEQ ID NO: 332560 - DNA, 3078 bp, Homo sapiens
tcctcgttaatttccaccaggaggaggcgcgcagcccagctcccctagtctctcttcttaaatccccctacctacggctgccgaggttggccgcgcgtcgggagtctccccgacagtcctggccctcccccgccccccgggttggtttttcccagctgcggaggttgggaggttgggccaggggctggggtgcgaagagagtcggcgcccgcaacgcggagccgggaagtcgtcgctactctggtggaactcagagttggttctggaggcggcggacgcggaggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacaaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaataaagattcttaaaagaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgtttcgaaatggtggatccttttagtatttaaatggagagtttgagtattcatgtgactgtatggtcccaaagttaatgctatttatgaaacagttttgtaagaacataatgaagttggtaaaagctaagcgttctgcacaataaacagttcccagtttggggctttttcaaggctaatgaagttattgttggtctagaaaaatagtatttacttaataaaactctgtttgaaattgttctgtggatttttagagcagaatttgaaacaaatgtaatgcaaataaatataaagataaagtgtcttaaagacaatattctgaaataaaagatataaaatataatttaaa

SEQ ID NO: 332561 - DNA, 803 bp, Homo sapiens
gacgagtctcctcgggaaaggcggagggcgggaggccggtcgggtttatttagtgtgggccagggaagaaggaagactttgcggtctgggtgtcggatgcgcgtccccctccggagtaaaagtgaccggaggggttggggaggcgaggccggggcgggcttttggaaggaggtctctgggacagactggagacgactagactcgaaaaggccggtttttgcactccggaagccgcggcagccaccgctgttcacgcctctctcctgcttgtcccaggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccc

SEQ ID NO: 332562 - DNA, 2339 bp, Homo sapiens
cttccgccgaggcggtgcaggaaggaacgggagagggagaagtttggtagggaaggaattggggattaagcggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacaaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgact

SEQ ID NO: 332563 - DNA, 2216 bp, Homo sapiens
tcctcgttaatttccaccaggaggaggcgcgcagcccagctcccctagtctctcttcttaaatccccctacctacggctgccgaggttggccgcgcgtcgggagtctccccgacagtcctggccctcccccgccccccgggttggtttttcccagctgcggaggttgggaggttgggccaggggctggggtgcgaagagagtcggcgcccgcaacgcggagccgggaagtcgtcgctactctggtggaactcagagttggttctggaggcggcggacgcggaggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccaggcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacaaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgact

SEQ ID NO: 332564 - DNA, 635 bp, Homo sapiens
ctctgggtcttgtactcagctcatctgaccctaaagcctgctcctgtgctgttgtcacttctgccttttccttcctcaggttaaaagcccagttttggctggaaaattccactaccttatctactctggggccaggtaacctgttaggtcttacaaaattgaattgaaaagtgaagtcatgggaaacctcttagaaaaatgactgctgttcctggaacaatccccaactggccctttctgcctcctccataaggcgaggtcagactcctcgtgagaaaaactatggtttgggtgtcaggcaaccccaatgcaataggatctgggggatcaaccccaattcaataggctccccaaatagtgcccccactttgtctcatggcctgaaatgccttagataatcaagaagtcttttaaaacagtcatttctcactgtgtttcaaaaaaacttctctgggagactctatcagatgcagcccactgggaagacaatagattaggtatctgaggaaccagaagcaccatcagacaggcaaataggctagctgagataagggcactcttggactactattgcttttgactgccaatgttcccaagtcccaggcttgctggtagtcagccaataagtcattgtg

SEQ ID NO: 332565 - DNA, 748 bp, Homo sapiens
tttgttaactgtatttatggtgtgcaatccactcaaactctagcatgaagcccaaaagataaatttatcaaaactatatcaacctgttaatagataatataaaaatatgtaaattgatacaactaaaagacaaaatgttggagggtggagttaaattatagaattcttttgtgggttttcatataaattgtctcagttcttcagttaaaagccatagagtagctgaatggataaataaatgagacctacctatgtgctcccttcaagaaactcacttcacctgcaaagacacatatagacaaagtggagaagggctggaaaaagatattccatgcaactagaaaacaagagcaagagtagctgtactcgtagcagataagataaactacaaagactgtaaaaactggcagtaaaggagggtcactatatgattaaggggtcaattcaaccagaggatataacaattataaatatctatgcactcaacactgcagctccatataaagccaacattactagatgtaaagggagagagagactgcaatacagtaatagtagggggctttaacatcccactctcagtaatagacagatcatccagacagaaaatcaacaaagaaacagcataaactgcacactagatacaataggtctaactgacatttcacccagctgctgcagaatacacattcttttcatcaacacatggaagatttttaagaatagaccatatcttaggcacaaacaa

SEQ ID NO: 332566 - DNA, 451 bp, Homo sapiens
tcggctctacctgtctctcggctctacctgtctctcggctctacctgtctattgacacagtatgaaaattatagccacaaccattagttaagaaataaaatgcatccgaagtggaaaaaagtagaactatctctattcacagatgacatgaaactcataaagagaaaaataccaagaaactcataaagctagtagagctaacattcagtaaacttgcacagtacatgatcaatgtacaaaaatcagatgtttctatatactagtaatgtacaatctgaaaaggatctaaataaagcaatgaagccatactaccactagaagggggaaaaaaggtgaattctctaaccttgatgtaggaaagggtttgctaactacaactcaaaattgggaagactgaaagattgatcgatttgactacataatttttttttaatttctgtatggccaaaaa

SEQ ID NO: 332567 - DNA, 1986 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332568 - DNA, 747 bp, Homo sapiens
  misc_feature (590)..(590): n is a, c, g, or t
cagtacggatgtgcccacggtggccgtgtgtacatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggacgtgtgtcgatgtcaacgagtgccagcgctaccctgggcgcctgtgtgaccacaagtgcgggccagtacggatgagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacatccgtanggcccgcgggccagtacggatgtggcgcctcaacgccaccaccaccctaggcctccagactgtgcctcccaatgctgtcccttgcccttgccacaccctgagcattaacataagagcctggggcctcataaccggcaacactggtggctgggatgcg

SEQ ID NO: 332569 - DNA, 1610 bp, Homo sapiens
aacgttaaggctaggtcgaggctgggtgttgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332570 - DNA, 2429 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggtaagtggcctagggggtctgctctttgtttatttcctcaggccgttctcttggcctccccttccacctctgctcccgcactgctgctcagcttacagagcagccagttaaggccccaagcagctctccccagtcccctggctgccagggagttcttgctcagaaaacctgtcccagcagttccttgactgcctgccaaggtgccttcatcaataccctgcacccgtcaggtaacgggcacctccatgtggggtggggcttcaagggccagaacatgaagggacaggctcagcacccctgggggaatgttctctcctctctttccactcaaagcctgtcttgtgctgctctgggcagcatctccgagctgggtgcggcacagggccaggtgtccctgtgcaggccaggtaccccaccctgacgctccaccctatccccacagggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332571 - DNA, 2729 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggtaacatggacccctgggagaggttctggagtcttggcctggcagacacctgggaggtgtagggttggggcctggcatagcgcagcctgctcctataggcatccctggtgtcctaggcagctgtcacctgcaggggtagcataggaggtctatagcagggatcccttctgcctttcctcttttgggctggggacagctgcatgctgcctgtgggagatctctgctagttggatgatgctgactggctgaggtggtggccaggtgcccgttagccagtatgccctctgcctcaccctgcaggaggtggatgccagtgtggtacgtgagatctgctccaagtacatctatgaccagtgcccagcagtggctggatatggtaagtggcctagggggtctgctctttgtttatttcctcaggccgttctcttggcctccccttccacctctgctcccgcactgctgctcagcttacagagcagccagttaaggccccaagcagctctccccagtcccctggctgccagggagttcttgctcagaaaacctgtcccagcagttccttgactgcctgccaaggtgccttcatcaataccctgcacccgtcaggtaacgggcacctccatgtggggtggggcttcaagggccagaacatgaagggacaggctcagcacccctgggggaatgttctctcctctctttccactcaaagcctgtcttgtgctgctctgggcagcatctccgagctgggtgcggcacagggccaggtgtccctgtgcaggccaggtaccccaccctgacgctccaccctatccccacagggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332572 - DNA, 1766 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccccaccacaaacacagcacttcggctcctctaacctgtgccacaggtgaccaccaataaaatcctctgctgagaa

SEQ ID NO: 332573 - DNA, 1616 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagaagttcaagagatttatggattatggttatgcagaaaacggggcattgcgtgggtgagagagatagatatgtgaccggaatgaaaatatggatgaaggtgaagagatggaacatgaaagggagagtggatggaacaagagtaacagggaaagaggaaagtaaggagggaccaggggcagaaa

SEQ ID NO: 332574 - DNA, 1520 bp, Homo sapiens
  misc_feature (59)..(59): n is a, c, g, or t
  misc_feature (72)..(72): n is a, c, g, or t
  misc_feature (138)..(138): n is a, c, g, or t
  misc_feature (141)..(141): n is a, c, g, or t
  misc_feature (143)..(144): n is a, c, g, or t
  misc_feature (146)..(146): n is a, c, g, or t
gggcggaagcaggtgggagggaatggtggggaagcaaggattggggagtaagggaagantaggtcaggagcnacagtaagtgcaggagaaggaggtaagaatggtggaaagagaggggtgggtgtggattgtgtatgnagngnngngaggagagttggagggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332575 - DNA, 1425 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagaccgcaccggatatgctaactttgccagtggcaggagaaaggccggcaggaaaccgaatgtgtgaatggaggacacgccaaaaggacatggcgggtcgacaaccgcaaggtggacaatcacaaccaacagtacaacagggggacgtgtgaaacactctatgagcgacagggaacaaaaaacggagg

SEQ ID NO: 332576 - DNA, 1900 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggactgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332577 - DNA, 1077 bp, Homo sapiens
ccaataggctaggtacgaggccgggtgttaatcggccgaggggaaggagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332578 - DNA, 1318 bp, Homo sapiens
  misc_feature (1151)..(1151): n is a, c, g, or t
  misc_feature (1154)..(1154): n is a, c, g, or t
  misc_feature (1158)..(1159): n is a, c, g, or t
  misc_feature (1161)..(1161): n is a, c, g, or t
  misc_feature (1165)..(1165): n is a, c, g, or t
  misc_feature (1175)..(1175): n is a, c, g, or t
  misc_feature (1181)..(1181): n is a, c, g, or t
  misc_feature (1190)..(1190): n is a, c, g, or t
  misc_feature (1193)..(1193): n is a, c, g, or t
  misc_feature (1197)..(1197): n is a, c, g, or t
  misc_feature (1203)..(1203): n is a, c, g, or t
  misc_feature (1205)..(1205): n is a, c, g, or t
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggagagtgggcccgcactgtgtgacctgccanaanactnngnggcncctggctttncgaggngcgtgcccnctntccngcggtntngggggaacccgcggggtgtcccttggccggctcggaaggcgtgcgggccgcaaagtgccgggcgcaccccccaatgcttgtggggccacccgctggcgtcacaccctcggggt

SEQ ID NO: 332579 - DNA, 917 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332580 - DNA, 865 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332581 - DNA, 1210 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacgggagtgtggattgatgttgcgcacgccgtttagagcaacttgcagcaagaatcatggcgcgcagtgcatagctgttttggtgagtcatctggcctttcacacgggtaacaatagaatcgtcctgtgcagctgccctgtgtagaagggacggtggatgatgcagtgggagtgccccagtcttaattgcctacagcaatccggaaattcaaccacatgggtatacctaccatcaaaagggcagactgtcgcaatggtatctgccgacaaaagctggtgttcaagctcctggcgtagaacatgtgtgccaaaaagacttgttagcttcatcgggaatggagcgtcacaagattgtaggtacacgagcaacggttggcattggtagaactacctgcgggagcatgattgcttagggggaacaagagtgcattcgccaattcctttatttggcggcaagtaattgctcgggtcccttcttgaaacctttaacgcttgtcgattgcccctaatcaggccctattttcccaagggggtcccaccacccttcgttatgtcccgccagggccctgttggcacgggcgggccc

SEQ ID NO: 332582 - DNA, 393 bp, Homo sapiens
gatgtgatcctgcgggagatgcaggagaatgatgcatctatgcgagatgtggtctttaactacctgcatgccacagcattccagggcacacctctagcccaggctgtggaggggcccagtgagaatgtcaggtgagagttggctggccttgtggggggatgcttgctccattctggcctggccagaccctttccaggtcacatttttagttggctagctgtcggggttattttcctgagttatgcaactggagacagtttctgtatccatgtggtccagtgagtcttttttaatggctttgtgggcttcacttgaattttgggctttgttttaaggtatgttttggtgcatgtcctgacagtccaagggcgaagtgtctgggtgtcccctcca

SEQ ID NO: 332583 - DNA, 786 bp, Homo sapiens
  misc_feature (685)..(685): n is a, c, g, or t
ccaataggctaggtacgaggccgggtgttaatcggccgaggggaagcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggangctgtctcgtgcagacttgacgagtactcacgcccattacaggccctcgatggctgcgcgctgccgatggcccccactgtttactcccaaccccgggctcc

SEQ ID NO: 332584 - DNA, 1625 bp, Homo sapiens
ccaataggctaggtacgaggccgggtgttaatcggccgaggggaagcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332585 - DNA, 1620 bp, Homo sapiens
  misc_feature (40)..(41): n is a, c, g, or t
accgtgcagtactcctacggtcttaggtcgaggctggggnncagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332586 - DNA, 2557 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaaaaaaaaaaaaaaaaaaaaaaaaaacaaaaaaagggggggggggcccttaaaggtttcccccgggggggccccaattttcggcggccccccggtttgtgttaccacaaggaggggccccccataagagggagagcgccgactataataagatcagaggcgacggagcaggcaggcgttataaacacacacgctggcgagcacggtggaacaaaacacgtccgacgacggcgggacaacctggggaacaagagaacccacatcaaccgcggggggaggggagaaacaatattgggcgcgaagcacaccagctcccacctcctacagcgaaggaaattatattaagacgccgctactaaggggaggaacaaacaattcgcaacagcttttttccgacagcgctggtcaaataatcggcgtggtgtcaacaaaccaaacatcgcgaggaggaaataaagcaggactacgcagacgagccgtcgtcaagaagatacttctggcaggccacacacagcgaggcgagactatgatctagtatgtagcgacagacaaaattttttttaacccccggggg

SEQ ID NO: 332587 - DNA, 2286 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggtaacatggacccctgggagaggttctggagtcttggcctggcagacacctgggaggtgtagggttggggcctggcatagcgcagcctgctcctataggcatccctggtgtcctaggcagctgtcacctgcaggggtagcataggaggtctatagcagggatcccttctgcctttcctcttttgggctggggacagctgcatgctgcctgtgggagatctctgctagttggatgatgctgactggctgaggtggtggccaggtgcccgttagccagtatgccctctgcctcaccctgcaggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332588 - DNA, 2457 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggtaacatggacccctgggagaggttctggagtcttggcctggcagacacctgggaggtgtagggttggggcctggcatagcgcagcctgctcctataggcatccctggtgtcctaggcagctgtcacctgcaggggtagcataggaggtctatagcagggatcccttctgcctttcctcttttgggctggggacagctgcatgctgcctgtgggagatctctgctagttggatgatgctgactggctgaggtggtggccaggtgcccgttagccagtatgccctctgcctcaccctgcaggaggtggatgccagtgtggtacgtgagatctgctccaagtacatctatgaccagtgcccagcagtggctggatatggtaagtggcctagggggtctgctctttgtttatttcctcaggccgttctcttggcctccccttccacctctgctcccgcactgctgctcagcttacagagcagccagttaaggccccaagcagctctccccagtcccctggctgccagggagttcttgctcagaaaacctgtcccagcagttccttgactgcctgccaaggtgccttcatcaataccctgcacccgtcaggtaacgggcacctccatgtggggtggggcttcaagggccagaacatgaagggacaggctcagcacccctgggggaatgttcttcctctaacctgtgccacaggtgaccaccaataaaatcctctgctgagaa

SEQ ID NO: 332589 - DNA, 1680 bp, Homo sapiens
ccaataggctaggtacgaggccgggtgttaatcggccgaggggaagcagctggaagatggcggcgtccgtggtctgtcgggccgctaccgccggggcacaagtgctattgcgcgcccgccgctcggtgaggtggtggcgagagcgcggggcttcgggacagggcttcgggaagcggacagccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332590 - DNA, 1484 bp, Homo sapiens
ccaataggctaggtacgaggccgggtgttaatcggccgaggggaagcagctggaagatggcggcgtccgtggtctgtcgggccgctaccgccggggcacaagtgctattgcgcgcccgccgctcggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332591 - DNA, 1462 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagaatcggcacggatgatgctctaactttggccacgtggcctggagaaaaggcctggtgggcacccggaaaagtgctcttgtaggggcacggcctctgggccaataagggcacgggggggggggacagatcaccagcgtgttggtgtgtccaaaaagctgaaggcacaccaacagctgacaagagtcgtccacatgtgtgaaaccaagaaacacgaggcgacacc

SEQ ID NO: 332592 - DNA, 1895 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggagtggagcaccagcaactgttagacctcgcccagaagcacctcggtggcatcccatggacatatgcagtcttactccatgccgcttcactggcagtgagatccgccaccgtgatgatgctctaccttttgcccacgtggccattgcagtagaggcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332593 - DNA, 1269 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332594 - DNA, 949 bp, Homo sapiens
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaa

SEQ ID NO: 332595 - DNA, 445 bp, Homo sapiens
tttgaagaccacgccatgccccatcaccccacccttggagatgcaggcaggtgtgagacaggtccacagcccatcactgccataataggtgaccatagaagagagggctgtgatctgagtcagcatgaggtcagggaggtccttgtcaacctgaggctggagattgtttgtgtacctgtgggtccaggattgggctgggtggacctctgagccttctctcacccttaaaggcactactcctgtgtgtgaggacatcggacgcagcctcctgacctatggccgccgcatccccctggctgaatgggaaagccggattgcggtaacatggacccctgggagaggttctggagtcttggcctggcagacacctgggaggtgtagggttggggcctggcatagcgcagcctgctcctataggcatccctggtgtcctaggcagctgtca

SEQ ID NO: 332596 - DNA, 397 bp, Homo sapiens
ggcaatcctgcctcccattctattcaaagtcacccctctgctcactgagataaatatgtatctgattgcctcctttggagaggctaatcagaaactcaaaagattgcaaccatttctttcttattgacctatggcctagaaaccccctctccacttggacttgtcccacctttccagacagaaccaatgttcatcttacatatgttgattgatgtctcatgtctccctaaaatgtataaaaccaaactgtgctctgaccaccttgggcacatgttgtcaggacctcctgaggctgtgtcatgggcatgtgtcctcaaccttggcaaaataaactttcaaaattaactgagacctctttcagatatttggggttcacagtagaataaagtggcagcca

SEQ ID NO: 332597 - DNA, 9395 bp, Homo sapiens
cattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagacatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatggtatgaaagatagtgcaacatctcctccttctcctcctttaccttccactgtccagagcaagactaacaccttacttcctccccagcccccacctattcctgcagccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaa

SEQ ID NO: 332598 - DNA, 9365 bp, Homo sapiens
cattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagacatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctggagaggaagacatagatgacattgctgacttaaattcagtgaacatagctgacctgtcagatgaggatgaagttgatactatgtctcccactatccatactagttcagatggaagttcaataagtggagatggccacaaactcacctttgggcagcgacttgtaaatcacctactaggcctgacacccccaaatcagcgccattctgttcctgcagagtatctgtgtgacccagagatgtggggctcccctcagtctagccagtcccatttgaaagcatgcagagcacactcatggggaaacgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatgccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaa

SEQ ID NO: 332599 - DNA, 8995 bp, Homo sapiens
cattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagacatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctggagaggaagacatagatgacattgctgacttaaattcagtgaacatagctgacctgtcagatgaggatgaagttgatactatgtctcccactatccatactagttcagatggaagttcaataagtggagatggccacaaactcacctttgggcagcgacttgtaaatcacctactaggcctgacacccccaaatcagcgccattctgttcctgcagagtatctgtgtgacccagagatgtggggctcccctcagtctagccagtcccatttgaaagcatgcagagcacactcatggggaaacgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatgccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagtt

SEQ ID NO: 332600 - DNA, 6622 bp, Homo sapiens
cattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagacatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctggagaggaagacatagatgacattgctgacttaaattcagtgaacatagctgacctgtcagatgaggatgaagttgatactatgtctcccactatccatactagttcagatggaagttcaataagtggagatggccacaaactcacctttgggcagcgacttgtaaatcacctactaggcctgacacccccaaatcagcgccattctgttcctgcagagtatctgtgtgacccagagatgtggggctcccctcagtctagccagtcccatttgaaagcatgcagagcacactcatggggaaacgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatgccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctggtactcaattttatagtttttaaattaaaatactgttttccaaaatt

SEQ ID NO: 332601 - DNA, 403 bp, Homo sapiens
gtaatatatatttcagccattgaaacaagtaataaaattgttgactcttttaccaaggtcaactacttttttatgttctaattataaaattaagataacaaaaattaattttattagtaaaatagcaataacagtggatactatcaaactcagaagtttatttaaggaatctctcatcacatttataaccacaatgcggtaagtgctttttagtaatgaagtacgctgctatttagacaagtttctgttttatttacataaaactgtggtttagaaggatagacaagttttatgcgtaaacttatagattatccaaagaaattaaaaggtgcatactagtagctactgctctagatttgtcagtttagaaaaggtatagtcacacagacatttagcatatgaa

SEQ ID NO: 332602 - DNA, 134 bp, Homo sapiens
ggtctgggaagatcacaattagattctaaaggaggagtagttggagggaccatagatgtcaatgctttggagatggttggtatgttgaaattttaaaactgacctaacatatccttaagatatatatatcaaaa

SEQ ID NO: 332603 - DNA, 591 bp, Homo sapiens
attcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacgtaagctattcagatacaaaggaaatgtatttaatcatttttgtaacttttcttctactgtagtaaagatattcagaaccttttttgaatgctaaatatttgaaaaagaagtagataaacgatataaaatgttttatcctgaaaatggcttaattctaaggatactgcaatataaaacatcatgaaatatatgttctataaaaagggaatcaattataaggagaacagggtaattttctagcttttctagctaggagtaaagcttcattatcaatgttaatattcaaatatttaccacacagtttttatataaagtatgttgtttcattgtcaaacttgaccttttaaataatctgatttaactcctttttaatttaaatcctgttttaattcatgacactggaagctatatatataataacctttttttcattttttag

SEQ ID NO: 332604 - DNA, 4959 bp, Homo sapiens
cattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagacatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacaatagcagaaattagaaggaagaagatcagcttcaaagttgtattctaatttcatagcatattaaacattatattaaaatgtttattttgttt

SEQ ID NO: 332605 - DNA, 2788 bp, Homo sapiens
  misc_feature (2778)..(2778): n is a, c, g, or t
  misc_feature (2783)..(2783): n is a, c, g, or t
tggtagaaactccttgtttagcaaagctttcctgaacactgtactgcaagtggataggaatagggaggatggccaagtcgtacaaccagggctaaaggatgaaaagaatgagaatatcaacttctttttttttttttttgagacagaatctcactctgtcgcccaggctggagtacagtggcacaatctcagctcactgcagtctccgcctcctgggttcaagcaattctcctgcctcagcctcccaagtagctgggattacaggtgcctgccactacgcccagctaattttttgtatttttagtagagacggggtttcaccatgttggccaggcttgtctcgaactcctagccttgtgattcgcctgcctcggcctcccaaagtgctgggaatacaggcatgagctactgcgcccagccgagaatatcaacttctttaggactactcaagaagggagtcaaggcagggaccttggtctgtgccactgtgacgcagagatgtataataccagtactcataagaggtccatctctaaattgccctcctcttacttcttccccctgcctcatgttttttctctttaatgactagcatcgaaactctttaaatggggcaggcctgtgttcttatctcaggaatagtaagaaaagggggttgggaacaggggaaatccagaataaagacttgagaaaggaacagagtgggtgatggcagctatgaagaaaaaacagatcagaagaagagtcctggcaccttaggaagagaaagtgtcacagacacgaggcctaggctagagagatggtgtaggtggtagctgctgtgaagaagaaatgacaacaggctggagctgttccctgaaacctgtgggaaggaagagagacctgcacaggccggcacttagcttgtggagaaggtcctaactcaacactgcaactttaagctggcttaacttgtccaagttccagatgaccaacaaagacagctatagacactctaactctgtgccaattacccaaggccttcagggccctgggacctattccatgatagtggtaccctaactgaacccatttcagccactcagattgatagggtggaaaagacagggcaggtggtagcagctgtgaagaaaagaggaaagcagaagggtggcctataatctacaggcatgtagagaggactacataggcctctgttctttgccctcaggagcccccttcctgtcccttggactcagaatggatccttccagcacacatggcccaacactgagagtgcaggaagcatgggtaggggcctcctgctgctggtatgtacccaggccagcctcctgccgacacagcctactggctgggttcatgttcttactattcacctcaggccattgtctgggtgcttaatttgacttgtttcccctggtcaccagtctcccctccgatattcacaggacatcaagcagcttcagccacgggtaagaggcttttcaccctgcctgttgggtagcccagaggacccacaaaggtcaacctgagtctccacagcctcctccccagggcagtaggaattgatatctcattcactggtattttccctctgtccctaattgggttttctatagttactagttttccaggcctccaagggagattctgaggcttgatgtgttctgactgtgtcttggctttgtgatgctgagtgccagaaatactctgtactataaaaactaccatcgttctttgaaacaacaaagaggaataaagaacttaattctggtgaaaaaaaaaacaaaaaaaaaaaaaaaaacaaaaaacacaaaaaacaccacaaaaaaaaaaaacacacaaaaaaaaaaaaaaaacacaaaaaacaaaaaaaaaaaaaaaaaaaaaaaacaatacaaaaacaacacacaaaaaaagaaaaacaaaacaaaaaataccactataaatataaaacataaaataaataacataaaaacaataaccactgaaacaatcactaactaatatacattacaactatatttatcacttcctcttcacctcctctttactatatatcaaccatccacacttctccgcatcaccttcttactctttgctacatcatacaaacacccatataagcatcacagatgctacaacaacgaataactaaagaaacaaaacaaaaccataaacaaaacaatatatatatattaataaattatacataaccaacaaacatactacaatcacatatcaatcttaatctaacaacatgactgatctaacaactatacatggaggatggagaagacagaaggaggagttgggcagacggtacctcattctgatagttgagggttgtagcgcgtgtgtggtagcagaggaggaggaagggaggcgtgcagtcggcgaggagcgtagcagccgaggcgagggtggcgatagagacgggacgtcgtgcgggccgagagcaagagaaacgatagatcaggtacgtagttctgactgatgataagcatcagtgcggaccagtggtctagggacggcatgtgggatgatcgaggacaagacgtacagcatgctctcacatcgaatgcaggagtggagccacgagttgaagctaggttgcgcgctgacgagctagtagcgcgacggggtgagcggaccaggcacaccgaccgcctcacgcgtcagccccaagctggcgagcagatgtaatcgatactagccggcttgacaacgagcagcacgacgacggctagacagccgagaggaggagacggcacgacnggggngagtc

SEQ ID NO: 332606 - DNA, 1650 bp, Homo sapiens
tggtagaaactccttgtttagcaaagctttcctgaacactgtactgcaagtggataggaatagggaggatggccaagtcgtacaaccagggctaaaggatgaaaagaatgagaatatcaacttctttttttttttttttgagacagaatctcactctgtcgcccaggctggagtacagtggcacaatctcagctcactgcagtctccgcctcctgggttcaagcaattctcctgcctcagcctcccaagtagctgggattacaggtgcctgccactacgcccagctaattttttgtatttttagtagagacggggtttcaccatgttggccaggcttgtctcgaactcctagccttgtgattcgcctgcctcggcctcccaaagtgctgggaatacaggcatgagctactgcgcccagccgagaatatcaacttctttaggactactcaagaagggagtcaaggcagggaccttggtctgtgccactgtgacgcagagatgtataataccagtactcataagaggtccatctctaaattgccctcctcttacttcttccccctgcctcatgttttttctctttaatgactagcatcgaaactctttaaatggggcaggcctgtgttcttatctcaggaatagtaagaaaagggggttgggaacaggggaaatccagaataaagacttgagaaaggaacagagtgggtgatggcagctatgaagaaaaaacagatcagaagaagagtcctggcaccttaggaagagaaagtgtcacagacacgaggcctaggctagagagatggtgtaggtggtagctgctgtgaagaagaaatgacaacaggctggagctgttccctgaaacctgtgggaaggaagagagacctgcacaggccggcacttagcttgtggagaaggtcctaactcaacactgcaactttaagctggcttaacttgtccaagttccagatgaccaacaaagacagctatagacactctaactctgtgccaattacccaaggccttcagggccctgggacctattccatgatagtggtaccctaactgaacccatttcagccactcagattgatagggtggaaaagacagggcaggtggtagcagctgtgaagaaaagaggaaagcagaagggtggcctataatctacaggcatgtagagaggactacataggcctctgttctttgccctcaggagcccccttcctgtcccttggactcagaatggatccttccagcacacatggcccaacactgagagtgcaggaagcatgggtaggggcctcctgctgctggtatgtacccaggccagcctcctgccgacacagcctactggctgggttcatgttcttactattcacctcaggccattgtctgggtgcttaatttgacttgtttcccctggtcaccagtctcccctccgatattcacaggacatcaagcagcttcagccacgggtaagaggcttttcaccctgcctgttgggtagcccagaggacccacaaaggtcaacctgagtctccacagcctcctccccagggcagtaggaattgatatctcacttttgccagattaggcttctcactcttcttgagtaggccataatccacctcttcagtaggccatgcatcttgt

SEQ ID NO: 332607 - DNA, 1526 bp, Homo sapiens
  misc_feature (1516)..(1516): n is a, c, g, or t
  misc_feature (1521)..(1521): n is a, c, g, or t
ccatccttggcctctggagctaattgagaaggctagggggagttccgctgtagggagaaggatgttgcatccctttgtagattgtgtagcattcaaaacctgctgaacactcaccctcaatgtatattctctgttctggcctgcttcaaggtcagttacactacttcctgggatgggcctttctctggcttaagcttggttgtccctggctttcccaaggatcacagcccaaaaggcacagtggggaaaatttatggcctattcgagaagagtgagcagcctaatcaagccaagccttgatttggggttctcacttcactggtattttccctctgtccctaattgggttttctatagttactagttttccaggcctccaagggagattctgaggcttgatgtgttctgactgtgtcttggctttgtgatgctgagtgccagaaatactctgtactataaaaactaccatcgttctttgaaacaacaaagaggaataaagaacttaattctggtgaaaaaaaaaacaaaaaaaaaaaaaaaaacaaaaaacacaaaaaacaccacaaaaaaaaaaaacacacaaaaaaaaaaaaaaaacacaaaaaacaaaaaaaaaaaaaaaaaaaaaaaacaatacaaaaacaacacacaaaaaaagaaaaacaaaacaaaaaataccactataaatataaaacataaaataaataacataaaaacaataaccactgaaacaatcactaactaatatacattacaactatatttatcacttcctcttcacctcctctttactatatatcaaccatccacacttctccgcatcaccttcttactctttgctacatcatacaaacacccatataagcatcacagatgctacaacaacgaataactaaagaaacaaaacaaaaccataaacaaaacaatatatatatattaataaattatacataaccaacaaacatactacaatcacatatcaatcttaatctaacaacatgactgatctaacaactatacatggaggatggagaagacagaaggaggagttgggcagacggtacctcattctgatagttgagggttgtagcgcgtgtgtggtagcagaggaggaggaagggaggcgtgcagtcggcgaggagcgtagcagccgaggcgagggtggcgatagagacgggacgtcgtgcgggccgagagcaagagaaacgatagatcaggtacgtagttctgactgatgataagcatcagtgcggaccagtggtctagggacggcatgtgggatgatcgaggacaagacgtacagcatgctctcacatcgaatgcaggagtggagccacgagttgaagctaggttgcgcgctgacgagctagtagcgcgacggggtgagcggaccaggcacaccgaccgcctcacgcgtcagccccaagctggcgagcagatgtaatcgatactagccggcttgacaacgagcagcacgacgacggctagacagccgagaggaggagacggcacgacnggggngagtc

SEQ ID NO: 332608 - DNA, 617 bp, Homo sapiens
gctaccaggaaagctgatggggtctacatgcacttttcctatatcccccactgacaagtacagtgaaggccgaatgctcagtgaacagtaactctctgccctaaatccagaatgaaatctcacctcatgtgatagtagtcatgaaacccaaagacacaatgtggagaggagttcacgagaatgcctggtatgaggagagcaccccaaatcactctttatgagctcatctcaaatctcgggctccacttatcccacggcgctgctcctgcctgagttctgcagccaagtgccctgtgattgccataagaaggaggaatgaggactggggggcggcgatgcagcaaactgaccagctgccacctctccattctcccagtcaatctctctgatcattgtctctgcgctagctcacagtctggaagcttggagagcctcttttgtttctccacttttttttttttctcagagttctctgtaaaagcatgttttgggttgtgctctcctgtttcaattaatttatatctaccctctgacttttaggaacttattatattatttgacaaagcacaaatgtgcagaaaatcctaggcctaataaacccagatgttctggatgca

SEQ ID NO: 332609 - DNA, 364 bp, Homo sapiens
gctaccaggaaagctgatggggtctacatgcacttttcctatatcccccactgacaagtacagtgaaggccgaatgctcagtgaacagtaactctctgccctaaatccagaatgaaatctcacctcatgtgatagtagtcatgaaacccaaagacacaatgtggagaggagttcacgagaatgcctggtatgaggagagcaccccaaatcactctttatgagctcatctcaaatctcgggctccacttatcccacgagccattgaagataatgatgaagagatcactcttaaagtgctctttttttcttttcagattttaatagtaaagcagaactttaaaaaaaaataaagctgataaaaatt

SEQ ID NO: 332610 - DNA, 719 bp, Homo sapiens
gctaccaggaaagctgatggggtctacatgcacttttcctatatcccccactgacaagtacagtgaaggccgaatgctcagtgaacagtaactctctgccctaaatccagctgtgactttcatggtccttactcatggaccttccacactgagggagcatgctgcatctggggaattttggatatcaggagcactgagaaaaagagaacacaaatgaaatctcacctcatgtgatagtagtcatgaaacccaaagacacaatgtggagaggagttcacgagaatgcctggtatgaggagagcaccccaaatcactctttatgagctcatctcaaatctcgggctccacttatcccacggcgctgctcctgcctgagttctgcagccaagtgccctgtgattgccataagaaggaggaatgaggactggggggcggcgatgcagcaaactgaccagctgccacctctccattctcccagtcaatctctctgatcattgtctctgcgctagctcacagtctggaagcttggagagcctcttttgtttctccacttttttttttttctcagagttctctgtaaaagcatgttttgggttgtgctctcctgtttcaattaatttatatctaccctctgacttttaggaacttattatattatttgacaaagcacaaatgtgcagaaaatcctaggcctaataaacccagatgttctggatgca

SEQ ID NO: 332611 - DNA, 599 bp, Homo sapiens
gctacacagccccagtgattactgctatgctggaaggaaggactaatgaatccagaatattctgagtttaaatcattttagtaattgactatgtaagctaaacacacatttggccgattctccttgtggctcagatgtctgcagagctgtttctggtgaggtctatgccccctcattgtgggagatcagggcagctctgtggactacccagcctcagactggactcttatctcctttcctatgtaagacatggaggccagggcttgaaagaaggggggctaagaggttctgtggaaagaaatccgcaacttccacagaagcaggtaattgaattcagacttacaatttaattcatctgtgttgattagctgtgattaaatttgttctggttctgtttagatctgagccttaatcatagcaaacttgttcaggtagggaatggtaggccttccgtcattacgtagcaagccagtgggtttgtctgcctttttggtgtggtatgtgagttcattctgcatacttgagtgagagaagcgtggcagctggaaagagcaggcttctaggagaagtaggataggaaaatatagcctgggttgggg

SEQ ID NO: 332612 - DNA, 500 bp, Homo sapiens
ggtggggttggggtggggagggcttgaaacctcacagcaaaaagatttgcatttagtctgtggaccagaaaccctcaaactccagtaatgatgtttgccagtctgcaagttctagcatatactttgcatctgtcctgaaatcacctcccttttagaaacatatgtatctctctacttagtgttatcttaagcattcatagtcacaatatcatggatttgccttgccagttgtatttttcccctaacacatcaaagtaagtgcacaggtattaaactagagaggatgtgcttgcccccctccaaaatgcggactcgcgtctgcctttggaaaccaggaccgtgggtttaggcagcttggaggcttgatccgatctggactacagaaggatttctcggaggttagaagggataggggaggcattcctgggaatctgcccttgtcccatgacaaaggtctgggggtgccagcatgcccccaagctgagagtgccactcttgcc

SEQ ID NO: 332613 - DNA, 217 bp, Homo sapiens
taaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaag

SEQ ID NO: 332614 - DNA, 4654 bp, Homo sapiens
tgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttctttttttttttggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaagaattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaagagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattacggagctgattttctagtctgtggatcagctatgcctttggacacttctcttttccattgtgccttttgaatgttgtcttctcactcagcatcagcacttcgatctaaatgcagactagggagttgggaggaggaaccaaagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaataacatgttccttggaacagaggaagaaaaaccacgaaaccatggaaattagggaagcctttacagagggtgtgacaaaactcaatttgacattttcaagctatgtacaatgatgtgcaccttgcagatgctcaataaagtaattactgacaa

SEQ ID NO: 332615 - DNA, 4629 bp, Homo sapiens
tgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttctttttttttttggccccttgaatggtataatacagtcctctccggtggaaagaagagaagagaaggtggacagccctgctcttagtaggtgctgcagatgattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaagaattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaagagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattacggagctgattttctagtctgtggatcagctatgcctttggacacttctcttttccattgtgccttttgaatgttgtcttctcactcagcatcagcacttcgatctaaatgcagactagggagttgggaggaggaaccaaagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaataacatgttccttggaacagaggaagaaaaaccacgaaaccatggaaattagggaagcctttacagagggtgtgacaaaactcaatttgacattttcaagctatgtacaatgatgtgcaccttgcagatgctcaataaagtaattactgacaa

SEQ ID NO: 332616 - DNA, 4600 bp, Homo sapiens
tgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttctttttttttttggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaagaattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaagagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattacggagctgattttctagtctgtggatcagctatgcctttggacacttctcttttccattgtgccttttgaatgttgtcttctcactcagcatcagcacttcgatctaaatgcagactagggagttgggaggaggaaccaaagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaataacatgttccttggaacagaggaagaaaaaccacgaaaccacaagctatgtacaatgatgtgcaccttgcagatgctcaataaagtaattactgacaa

SEQ ID NO: 332617 - DNA, 4351 bp, Homo sapiens
tgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttctttttttttttggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaagaattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaagagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggctgttccacgtcggccttgatatcacctctgggactgtgccttgctcaccgaaacccgcgcccaggagtatgggtgatgccttgcccacccacctgcctgggaagtgcacagaggatggactggttcagtagtgaggggccacatgccttgttactgtaccgggctgtcacactagtacatcatttccgccaagagacggctactgactctttatgaggaccctaagcataccaccgttgaatattgagtcttgggatcgcc

SEQ ID NO: 332618 - DNA, 2038 bp, Homo sapiens
tgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagcc

SEQ ID NO: 332619 - DNA, 4622 bp, Homo sapiens
tgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagaaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttctttttttttttggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaagaattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaagagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattacggagctgattttctagtctgtggatcagctatgcctttggacacttctcttttccattgtgccttttgaatgttgtcttctcactcagcatcagcacttcgatctaaatgcagactagggagttgggaggaggaaccaaagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaataacatgttccttggaacagaggaagaaaaaccacgaaaccatggaaattagggaagcctttacagagggtgtgacaaaactcaatttgacattttcaagctatgtacaatgatgtgcaccttgcagatgctcaataaagtaattactgacaa

SEQ ID NO: 332620 - DNA, 4600 bp, Homo sapiens
tgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttctttttttttttggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaagaattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaagagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattacggagctgattttctagtctgtggatcagctatgcctttggacacttctcttttccattgtgccttttgaatgttgtcttctcactcagcatcagcacttcgatctaaatgcagactagggagttgggaggaggaaccaaagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaataacatgttccttggaacagaggaagaaaaaccacgaaaccatggaaattagggaagcctttacagagggtgtgacaaaactcaatttgacattttcaagctatgtacaatgatgtgcaccttgcagatgctcaataaagtaattactgacaa

SEQ ID NO: 332621 - DNA, 4229 bp, Homo sapiens
tgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttctttttttttttggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaagaattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaagagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcatgataccacaaggcacgacgatgtgttaaacagacggccatgtccaagaaccac

SEQ ID NO: 332622 - DNA, 4152 bp, Homo sapiens
  misc_feature (4147)..(4147): n is a, c, g, or t
tgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttctttttttttttggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaagaattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaagagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagagggttaaagggggtggttcctccctctattatcatttttgtctttcccactttttttatntatta

SEQ ID NO: 332623 - DNA, 4029 bp, Homo sapiens
  misc_feature (3704)..(3704): n is a, c, g, or t
  misc_feature (3824)..(3825): n is a, c, g, or t
tgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatatgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttctttttttttttggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaagaattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaagagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatggccgggtatgaaccagtgcctcctgtacaacttggtctggccagggacatatcctnagaaattggctgaagggcccaggcacagggtgccctaccttggacacaaggtgaacggagcgtcaccacggacaaagcgcgccgcacataggctcccttttcttgatatgaacactttcnncgccacgcggagaggcacaaacaggccgacgacgcgacgagcgcccccgcaacgacccagaccagacgcaacgacgaaaccgaggagccccgacgcgaccaagcaagcagggagaacaaacgcaaggaaggagacgggagaacagccaaccagaacacaacgcaaccacaacgaagagacaagccagacaggagcccaccacgc

SEQ ID NO: 332624 - DNA, 207 bp, Homo sapiens
gaacctctttccctagctcttagatggcacctaccgtgtgccaggtactgggctaaatgcttcgtgcgtaccacaaccctgcaggtagttaccattattatactcattctccagaaggggaaactgaggcacaaggaacatgcactgtcttacggttatctagtggcagagacaggacccacaccatctggcttcagagtccaagct

SEQ ID NO: 332625 - DNA, 282 bp, Homo sapiens
gtattgagtcttatttgtctattcagtgaatatttggataccaactctgctgttctgggcatgatgttagccactggggagacagaaggaatgaaagagatgagtaacctaatgtgtgctgtctagtggggactgcaaataaagtgggtgttaccactagcgtgctctacagtgttatgctagagagaaatttacttcctttggccactcacttccttgtttttaaataagaactgagttaaagttgctaactgtgaagactgagtaatttgaatctgctgt

SEQ ID NO: 332626 - DNA, 1124 bp, Homo sapiens
cttcttgttgtacttcttcgtacggtgttcctcggtcttgtcgtccgctttccttcttttccttttttcttgtcgttctctgttatgtttagtgtgtgtcgccccccagggggggggctcttcttttgtattttgctgcctccctctttgggcaccccccttgttggtgatgggttcccccctctgtgtgcccctcccgagtctcctctcttcggggtgtttttcaccaaacccctcgctggtggtgcccccgcgcgggctttttatatgtggtggagagagatcccccgccccgttgtactcttccccggtggtctccccttggaccccctcctgtggccactgcttgctcctcttcctccgtgggcgcccccggcgcccccaccccgggtgttgtttctgaaaaccttcttctcagggcccagcgccgctcgcgcagcaaacggttttgtttttttttttttttgttttttttttttaattttttttttttttttttttttttttattttcaattgtctggtgtttccagcttttattggctcttgtcgaaatcaaattggaagatcttcagtcccagctgcacccaacgtggaaaagtattccaggtccatccccaaggaaccaacaccgatgacatggactcaggaatcttataacctacgtggactctttccatccgtacattgtcgtgcacatgccactcatcacctggcgtgcccagatcctcgcagggcaacaccctgtgataattccaggtgattctctacatctgcagcttgaggttagcctcatatcacattacattctcactagaaacaaaacaaaaatgaaatacttaaaacatctaccagaacagaattaggactggaaagcagcggtcttagctgacaaacaagttgtgccatctgagactcatgggagtaaatctcctctttcatagtaaaatctcattacagaatgttccttgactttggcaatttttctgggtcacaagcaagaaaaaaacataagcaggcggagagagctcgccctgccacctggggcttgtgtgtcagcagctccagagaggaattgggatgtgaaaagttcagccaaaatagaaagaattaacatttttgcta

SEQ ID NO: 332627 - DNA, 306 bp, Homo sapiens
tgcggtgattgaaaaaggaagcatgattcctggagcatagcatacctcattccaggtattagtcatagacttgtgcatccaaagagccacatagtctgacatccttcagtttctccagttcctttctccagaatcagtgaggcccaaattctacttaagaacaaaatggatttgcatatacaatagggtcactcaacaggtaatgaaataatgggattgtaaaataattcagaaggaccacctggtcaccttttctctcttgtattttatcctctcctcttacagctctgtgtccagatgtggtag

SEQ ID NO: 332628 - DNA, 3874 bp, Homo sapiens
ccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcccgttcccggtcccttttgtctttcttggacgcggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacagcacacagagccgctgaaaacgactgaagagagcaagggatttcctgggacatctggctctggagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatcagaaaattttcatgttttcctttaaggtaacataattgtaagaattgtttaataaaatactcaggaaattctaaaggtttctcccaatacctaaacatttctgaacatcagtattgcagttgtggaagagcagaaggaggatacatttgtttgtgttgctccccaaaattccaccttgcatttgcatcacaaacttccctcaattgaggcagttttctttgttagaacattaagtctgtgtattgtaatagagtgggctcaatattttactataaagcatttaataaactgttattaatagaagtttgtgttcttcacacctttgctattgctttttaaataaaatgtacatttctgcttaaag

SEQ ID NO: 332629 - DNA, 589 bp, Homo sapiens
tgcccccagagcaataaagtcagctggctttctcaaaaaaaaaaaaaaaaaaaaaaaaaacgtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatcagaaaattttcatgttttcctttaaggtaacataattgtaagaattgtttaataaaatactcaggaaattctaaaggtttctcccaatacctaaacatttctgaacatcagtattgcagttgtggaagagcagaaggaggatacatttgtttgtgttgctccccaaaattccaccttgcatttgcatcacaaacttccctcaattgaggcagttttctttgttagaacattaagtctgtgtattgtaatagagtgggctcaatattttactataaagcatttaataaactgttattaatagaagtttgtgttcttcacacctttgctattgctttttaaataaaatgtacatttctgcttaaag

SEQ ID NO: 332630 - DNA, 3343 bp, Homo sapiens
ccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcccgttcccggtcccttttgtctttcttggacgcggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacagcacacagagccgctgaaaacgactgaagagagcaagggatttcctgggacatctggctctggagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttcatggcggtccgtgtatcctctaga

SEQ ID NO: 332631 - DNA, 361 bp, Homo sapiens
ctcagcctcccaagtagctgggaccacagggatgcaccacctcatttatttagttttttgtagagatgggggtcttaatatgttgcgtaggctggtctcagattcctgggctcaagcaatcttcctgccttggcctccgaaaagtgttgggattacaagcatgagccccagaaactggcccatccccaaatttagtaggttaaaacagtgaacatttattatctcagtttctggggttccggattctgtgagtgccttagctggatggttctatctcagagacacttatgagatggcagtcaaaattttagcaagtcatctgaagacttgatggggactccaggatattttttgtgtgtgt

SEQ ID NO: 332632 - DNA, 704 bp, Homo sapiens
gttcagaccccctctatgtaggaaagatatggatctataacagatgaataaactgggacccaagcaccatcaagacagcacaacatggagcagaatggagattcagtagccatacctggggcttctttgcattgaccttccaattgggccactctgcctctaagaaaatggaccgtgaccccctagaatggctgtttctcacaagtgaattactgtgaactttttctgagaataaaaacaatatgagtagtattttttcttttcatttgttacttaataaaagaaatgatatttagggcaatattaccattacctatgcacttcctgaattatgtctctttcctttattcttgtttgtaaaacaattaatatcttcttaaaccacacgtcttcattagagatgctttataagtgaattgtgttccattaccttgaaccacagtaataattataaattaggaatacttcaaccagaaagaaatgactcatacatttgttttcatctgtaacatttattcaacagcttgataattgcaatatatacagtggtatgtggaacactatttattaaaagacataatagaaaacttgtttataatatgtatattcaggcatttttacttctgccaatcattgtttaaatctaccttctatacttaaaattttaccttgtaaaatttaataaaataacctgtatggttcta

SEQ ID NO: 332633 - DNA, 557 bp, Homo sapiens
ctctgtcagatctattaggttcttttttttataccggctatttcatccttaagctcctatatcattttattgtgaaaaatttgaaatgtttcatgaatttgtatgccatcatttcacaggggtcatgctaatgctctctgtatcagtgcagttttagtatatgtgctgccccagtgggcagtaaacaacatacttctaaataactcctgagtcaaataagaattcacaagagaaaatagaaaacatttctaaaaacggtaaaacaaagtatcaaaatttgtgtgatgtatctaaagcagggtttaaaaagaaattcataatttcaaatctatataatttaaaaataaaaaggtcaaaaattagtaatctacaattccatttgagaagctaagaaaaaaaggggaaattaaatacaaattaagtagaagaatgcatacattaaggataagatcagaaatcaacaacatagaaaaagtagagagaaataacaaagcctacagttgattatgtaaaaaaattaataatgctgacaaatcttatcatcagcaagattaaga

SEQ ID NO: 332634 - DNA, 161 bp, Homo sapiens
tgttcttctgctgctgagcacttgggctgtttgctcctgtgtccatccttgtcctgtccccctggtgcacacgtgtttctgaaggatgtacactcaggagtggggttgcttgggcgagcgtttgtttatgttcagcttcacccaagaggtgcacaggggct

SEQ ID NO: 332635 - DNA, 355 bp, Homo sapiens
gaaatggaaagtccagcactgtttccttttttttttttttccacttcaaaggggagttaataacacctgtttactccgaatttgaaaagtagcactgtaaaagtccttgagctgtggaaacacattaagaagatgcttttgttaaaaatcaggtaaagagtgtggccttagcattaaagcttgagaccctcaaagtagccgccattagattgaggcagtaagtgcaatcacggtggtgaaaaagaaaaaaaattgacgagtaaaatatgtagaaaatggctctatatgtggctattggaatatggaactaaatcaaaacaaatcagaagttaactgtgtttttgcaggaattgta

SEQ ID NO: 332636 - DNA, 121 bp, Homo sapiens
aacatttcttcacatcatgaatatgtgaggaaaaaatgtattttaaacaactgataggtacagaccctaggaacctgcattctagccccaatgttgccactcagtgacatctgctatgtga

SEQ ID NO: 332637 - DNA, 117 bp, Homo sapiens
ggatctgagatgataaagagattattacagaatttgttttcataaggaactgtgtaattatgatgattagccaaagaaataagaaagaaagaaagagagaaaaagaaagaaaagaaa

SEQ ID NO: 332638 - DNA, 366 bp, Homo sapiens
ccttgctattttttttttttttttgagacagagtcttgctctgtcgtccacgttggagtgcagtggcgtaatctcggctcactgcaagctccatctcccgggttcatgccattctcctgccttggcctcccaaagtgctgggattacaggcgtgagccactgtgcccggcctatccttgctattttataagctttattgagatgtagttcacacaccatataattcaacattttaaagtatatgaatcaatcattttcagtttattcacggatacgtgcaactctcaccacaggtaaactttagggtatgttcatcactctggaaagaagccccatgccctttagcaatcactctccctactctac

SEQ ID NO: 332639 - DNA, 147 bp, Homo sapiens
tgtgtctcgatctcctgacctcatgatctgcccgccttggcctcccaaagtgctgcaattacaggcatgagccaccgcaaccagccaactatcatcttatgtggttaaaaaaaacaggtctttacagatataattaagactcttgag

SEQ ID NO: 332640 - DNA, 295 bp, Homo sapiens
acttctttgagcctctctttgcccatctttaaaatagagagtaggagtgggaactgcatgcttttgtaaaagcacatacagaacaatggacacagagatgtcactcaataatagctactttcattactgggtaaatcgaagctactgtcatgactttttccaccttctttcctaacaacagagaaatctgttagaggttcaggtcattgttttgatgtaattctctttaaataatatttctttgcccctttgaatcatctactactctcaaatgtactctcaaggagagaataca

SEQ ID NO: 332641 - DNA, 2178 bp, Homo sapiens
agacagcttgttagagctgagctgccctactacagcagctgccggcccctaggacagagcagggacctcaactacactgatcaccagccccatcggatccagacccggccaccagctctggctcgtcttgccccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaac

SEQ ID NO: 332642 - DNA, 2265 bp, Homo sapiens
agacagcttgttagagctgagctgccctactacagcagctgccggcccctaggacagagcagggacctcaactacactgatcaccagccccatcggatccagacccggccaccagctctggctcgtcttgccccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtcagtcactgcctctggccccatcagtgctcctccctggggaagcaggtctgggcccagggcttttccttagctctctgtccctaggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaac

SEQ ID NO: 332643 - DNA, 3260 bp, Homo sapiens
agacagcttgttagagctgagctgccctactacagcagctgccggcccctaggacagagcagggacctcaactacactgatcaccagccccatcggatccagacccggccaccagctctggctcgtcttgccccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtcagtcactgcctctggccccatcagtgctcctccctggggaagcaggtctgggcccagggcttttccttagctctctgtccctaggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaactctagccatgatgttcaggaatgggggtgggatgggagctggccaccgtgtggacacgtgagcatgcacatctgtccatccacacttcatgtacgacaggcctgtgtacaggcaccacaggtacatgcaagctggactgatgtgaacatgagcaagcacatgtgagtgctctgaggtgtgtacaccacgcctgtgcatgaaaatacatgtgtgtgtctacacgtcccagcatgcatatgagcagatgactgaccaagcccacagcagaacagccaatccctccaccagcagccatccctttccctctggggtctctgcccattccctctgtcttggctgccgcccatcaccagttaaacaagcttaggcttctcccaacttaacaaaaatcaacacaaacacatgccaggatgttgtatctccttccaagggccacactggctctttctccccttcgaagccagacttcataaaggagctgtctgcctcccctgtatccaccttctagcctcatacatctcccccactgcactccggctcctaccccttccctccctggaaccgctttcaccaaggacgctcatcccctccctgtgctggatccataagtcactcttcagccctcctcttactggccttttggcaaatttggtcctactggtcactctcttcttccttagtttctgagaggccacgtgtttgcagctcccccccacacactggctactccttctcaggcccctctgcggtatcctataaatgctgcagtgttcactttgcctatcctgcccccaccccttttctaaggatctgcatccccggaatctgccaactgaacagttccataatctgccatctctggtggtgaccaactagaccacagggcactccagatccaaatctcatttatcacatactctctcctgggctaggatttgagatcttaagaggttcttatccatctctttgtccttgccctgggaaggcaggttagc

SEQ ID NO: 332644 - DNA, 1905 bp, Homo sapiens
agacagcttgttagagctgagctgccctactacagcagctgccggcccctaggacagagcagggacctcaactacactgatcaccagccccatcggatccagacccggccaccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaac

SEQ ID NO: 332645 - DNA, 2244 bp, Homo sapiens
agacagcttgttagagctgagctgccctactacagcagctgccggcccctaggacagagcagggacctcaactacactgatcaccagccccatcggatccagacccggccaccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtcagtcactgcctctggccccatcagtgctcctccctggggaagcaggtctgggcccagggcttttccttagctctctgtccctaggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaac

SEQ ID NO: 332646 - DNA, 2894 bp, Homo sapiens
agacagcttgttagagctgagctgccctactacagcagctgccggcccctaggacagagcagggacctcaactacactgatcaccagccccatcggatccagacccggccaccagctctggctcgtcttgccccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtcagtcactgcctctggccccatcagtgctcctccctggggaagcaggtctgggcccagggcttttccttagctctctgtccctaggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaacaaaacgaaacgacaaaaaacaaaaaaaaaaaaaaaaaaaaaaaaaaaaggggggggcgggacaaaaaaaatacccccaggggggcgcccacttatatcagccttcaccccgcatttttctgtgtaaacagaggggggccccctacagagagggaggcggcaataacactagcccagaggcaccgtccaccgtgcattataaacacaaggtgtgcagtgagcgcggaaaaactcgtcggaacgggaggaacaactgtgggcgaagggaacccccccacaagcaacgcggaggacgaggggggggcaacgcaaccactatagtgcgcacagaaaaccaccactccctccgcagcagaagaggcgtcttatcacacacaccgcgcccgccaaggaggggaggaacgaccactaatcataacgacatcggatcgccacccaagcggtcgtaacactaacactcggcgggctgcgcacacacaacaagcgcccggcgacgactagaattacgacacgcacgagccaggtatccagaagagaacaactgagtcggccaccagcacgagcggcgaaagtaaatcatacgtctcgctagcgcgaacccaactattattctactcccccgcaggacgt

SEQ ID NO: 332647 - DNA, 301 bp, Homo sapiens
ttgctaggaaaaggcagacacaccagcatttacacaaattcagttacatcactagtggtaggtttcacataaaaacctttgatttatgagaaggctatgcacatgttacacatccagtcagaaccaatcatgcactctaatcatacactttaatttcccgtgtgttgtgagagggacctggtgggaggtgattgaatcacggggtcaggtctttcccgtgctgttttcatgacagtgaataagtctcatgagatctgatagttttaaaaatgggagtttccctgcacaagctctttgcctg

SEQ ID NO: 332648 - DNA, 138 bp, Homo sapiens
tggctggatttgagctcccgggctcaagtatgatccctcccacctcagcctcccaattagctgggactgctggtgtgcaccactgtgccagggtttgtgattgtgttttttgttgttgttcttttgtttgtttgtttt

SEQ ID NO: 332649 - DNA, 615 bp, Homo sapiens
gcaatgaatattttgacttcagtgctgcttctatatgcaaaagaggaagaagctttttggcttctggttgctgtatgtgaacgaatgttgcctgattattttaatcgtcgaattattggttcagatgattttatgccactagtaagaatccaaggacaatgtgttattggggagaagtagaaaaaggaaaatctggggtagcacctggcatgctctttctccaattttctactacttactcctattccccaaattctcccatcaaggaggaaatgaactctgagacagaagatgagttttcctcaaagcttgaccaggatataagtggatgccttattgggcaaagcagagggtaaccaattagaaggccctggcttctcttgattgatagctgagaactcatcagagggatcagtgctttctctgtgtattgctggagtctgaaagtgtgactctcatgtcactgattcatttctgaagtgttaaattcagaataaatttttgataatcaaaatgaacttagagaactttgttgtttggcattgtcaagagtgaagaattctaattatttgtgtatttatcttgtgttatgctagatattaaactccctgaaca

SEQ ID NO: 332650 - DNA, 159 bp, Homo sapiens
ccactttggcctccttgtcttctcaactctgatctctgcctacccagctgggcaagactacagaatttacagaactctgaggttcctccttcctgtacctgtggtctggaaattgcctccaaacagaaagctagggcaatctagggctcacctcatttg

SEQ ID NO: 332651 - DNA, 324 bp, Homo sapiens
gtcagttaatacctgatctgatcaactatgaatcaaccctttggttatactgtaccaaacattcccaatatatatagcgtgtattgaaccatgaaatttcaaagaaatggaatgtgaactgtgtgggtatgctaacttagatcctttacttatcaaagtcaatgacctcttctcattcttctcaagttctccataaaattagtataaccaagtcccttttctttctaaggtctattaaaatattccataaattttaatttcatgcatcttcctggctctcttccaggcactgctttcttggatttcaacttattccccccctag

SEQ ID NO: 332652 - DNA, 317 bp, Homo sapiens
tgacagatgaatgcatggatgaatggctacacagatgcagctacagagatggataaagaaacagagatggctggaaagaaagaaactagttgaggtagacatataagttaacaatattttataaaaatgatttcttccttgagaagggaagttcttccatctgaccttatgcaatcacatagcaattttacaagaaaaggaatctgggcatcgtggacaaattccaataacagttgatataagtagcatatatctgttttaaaatccactgtaatatcaggatttttcttctttatatcgaggaactagcatgctgc

SEQ ID NO: 332653 - DNA, 376 bp, Homo sapiens
tcaccattagaggtatattcctttgtgccgtatttcaaatgcagaaatgacagtggtcctgtgcaaatgggatttatttgttcatttagcagatatttatagagcgccttctgtatgccaggccttgttttggatactggaggtactgcggagaacaaaacaaacaaaagtccctgtcctcattggcacgcacactcttgggaaaaggaatggcagacaataggcaaaatgaatgtaattatcatacagtatattagaaagcgatgtactgtggggagaaataaagcaggagaggaggatgggggtgggcggtttacaattttagagtggtctgagtaagcctcactgagaagatgacattttagcaaagaaaaat

SEQ ID NO: 332654 - DNA, 115 bp, Homo sapiens
tcaaattttactgccactcaaagtcccagcatgacattttcttgaaaacaaagcatcccatttctgattgctccacaccaggctgaactgcctgcttctgttgcccacagctaaa

SEQ ID NO: 332655 - DNA, 198 bp, Homo sapiens
tttatgagactgaataagaactgaaaaaatggaagaaaggacatgaggtaaagggaggtatctggggaaaatcttcaggtaatatttaaaaatatattgctacatacacatccttactgttctttgggcatggattcatgagattaaaaaatatttgaaagacatttaatgctcaaagtaatatggcttcaagataag

SEQ ID NO: 332656 - DNA, 799 bp, Homo sapiens
gaacccccacccccagccaggggaagccgtgagtgattgtgtgaccctgcctgggaaaccatgcttctcccatggatctttgcaacccatgtatcagatcccttcatgagcccataccaccacagccttgagtctgatacacagagctgtttggagtctcagcagagcagctgctcaggcatacacagagacccaagagttttacatactccggctctgggatccctggcaagacaagaaatctgtctgtacatatccctaggaaaggggctgaatccaaggagccaaacggcatcattctgcaggctgcacttccatggcacctcacaatttaagaccctctggcttggaatcccagccggccaatggcagtgaattagagtcctccttagaagggtccaagttcccaggaagagggacggccacagttcagtcaacttacctgcttcagcctgccagctttggagaacacaggcagtccggatgagggagggtcccccatctccagtgcagcacattggctctaccaaaaagcagccagatccctgatcctgttcctcctgactgggtgagtcctcccagtaggggtctccagccacctcctacaggtgggtgtgggccagcaacaggtcagtaaccactaggacagagcttccagaggaaggagctggctgccatctttgctgtttcacagtattcactggtagtacctctaggtatgggagaaactgaggcaactggcatctggagtagaccgccagcaaatggcaacagccctacagtagaatggcctgttaaa

SEQ ID NO: 332657 - DNA, 240 bp, Homo sapiens
ttgataattactgacactgggtgttagtacatggggactcactatatatagtattgtccctatttttgtatgtatttcaaagtttccctttattaaatattaaaatacaaaaaaccaaagtgacaaagcaacactatttccacttatttttgcaatgacatttcttttataataggaaataacaatattacattttaaaatattgataatgcattttagaatagttacaatacaattctt

SEQ ID NO: 332658 - DNA, 207 bp, Homo sapiens
ttagggaatctaataaaaataatccacgcttataggagaaggctacagagctttgacttcctagccaggcctccctttctccccccagtggaattttaatatgtttcctcagcagacagggcccaaaggattagctaaatgttggatctcaagtgaggagactgatgccatggtaaatggttgggggaagactttagagggagagtg

SEQ ID NO: 332659 - DNA, 79 bp, Homo sapiens
ccactgcagtacattgagctccatagagacagcgccggggcaagtgagagccgtacgggcactgggcgactctgtgcct

SEQ ID NO: 332660 - DNA, 170 bp, Homo sapiens
ccaaaagtttctaaaggccttgggatactagaatgtcagaaccacagaccctagaaataacagatttgtggaaccacaaagaactttcaaggaatagaatcttagacacagtaaatcttagaaacaccaaggctgggtgtggtggctcatgcctgtaatcctagcgcttc

SEQ ID NO: 332661 - DNA, 464 bp, Homo sapiens
cccaggatcagaatttttagctggaaaggatcctaaaaaccgaaccctaatctcctgtgttgacagatgaagaatcggaggcttaatgtggcccgcccatggccacaacagaactcacaaatggcagagctagggagattaatgactcataataaaaaatggaaaaacacagatgtttcatgaattatattcaaataaagctcctttcttacagagaataaccctaagacttcaacagaataaggggtgccaaggtggcatctggtgggagagaaaccaggggatttgtcttgaagttgggttcgaccagctagaacactgtttatttagattagtaaaaatagcagttttctaaacatactcttagtcagactttacagactttacattgagagtcttgagttttacaagtgacctcaaggctgtctggttcataatgacctccagtgggagttggctctttt

SEQ ID NO: 332662 - DNA, 374 bp, Homo sapiens
atcaaaccattcctcacaccacattccatgatacccttgattctcttggctgaggttctcagtattagctctccccttttcaccttgcctctcagacttggttcaagataccccttggcttcccctctaattaaacctattctccactctgtcccatctgccatgttcccaaaacctgcaacttctgcacagccctgtggacaagcatctcacccatttatcaggtgtgaggattaagcaccaactagattctcttagtgggaggcctatcaaaaagcattctttaaactcttcttttaaactgatgatggtacaaagcactatagaaacagacgaggaaatacaaagtatgactctagaaataagcaataatg

SEQ ID NO: 332663 - DNA, 3005 bp, Homo sapiens
  misc_feature (1927)..(1927): n is a, c, g, or t
gggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaatggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctaggacctgaattggtcttggaggcagcttttagaaatcctctatgtagttcctgtccacatgcactatatatttgtttcttctttctcctctcatgaatctgctcgtttctctacttctgtctacgtagaagcactcagcaactagtttctgctcattaaatgtgttctatatactaggctcagtgctttacatgtgtttgtcttaccngagtttcacttttccaaagtagtcatccacaaagtatgaggcagacagatctaagagaagaaagacagctgaggtagattcaaatcttttctgacatggatggtggctttttactcagaaatatatacctatttccatgggtatttgtgggcctgaggcatgcttggcaagaagagtctggtttctcgtctgctatgcaagccaaagggactttaatgttctttgaattgaaccctccttagctctgtggaaagagacagtcaggaatatttgggaattagacggcaatactttgtggggtttattagagcccatgcttgcctccagagatacagttcttttagtgaccagatactgccaaattgatgtgttcttgctttccaggtgagctttttgttcttaagattaagaaacctatgaaggatctgcagccaggcatggtggctcaggcctataatctcagcactttgggaaatcgaggtgggtggatcgcttgagcccaggagtttgagaccagcctgggcaacataatgaaaccctatctttacaaaaaaatacaaaaattagctgggcgtggtggtgcacacctgtagtcccagctactcgggaggctgaaatgggaggattgcttgagcctggcaggtcaaggctgcgatgggacatggtcatgccactggacgccagcctgggccacagagggagaccctgtctcaaaaaaagaaaagaaaaaagaaaaaggtctgcccacaaaatcactagcttattatttgcttcctgtgtgcctgcttgtctacctagcatagtaggccaaaggtccaaaggcatttagcattcctaggggaaattgtggctgtttttctgagccagatctcttgatttgggtttacacggagtcctttcatggactatcctgagtattgtcagtaaaacgtcttggggcataagaacttgtctgaatctgtcatacataccactgctgtcttttccgagtggtattacaagaaagatttttgtggtgtgtttgttctaagagaaatgccaaggctttcagataaagataagatgataatgattgaca

SEQ ID NO: 332664 - DNA, 2196 bp, Homo sapiens
gggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggtaagtctgtgggcccgtcctcccttcgctggcccagatttcgggctccgactcctacctggagtgtgaatggcagtccttgacggacagccttcaccgtttgctgggcccctagcctggcccttggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagtaagtatgaatgaaggaataaattaatacataattttagtagattagttaactgcccttctttcgtcattgttcagttgaagaatacctgctatccctccaaagtgtataaaaactcatgttgcaatgggtaccttatatttgacgaaaaaaaaaaaaaaaaattaacacgagctcatttcttgtactttgcggatgtgctaatttaacttgctcctttggatacttggcatctagcaagagaactacccccttggggggttgaggatttgagaaggcatcggggaggattatctcgaaactgactcactgctgaatgtgtgcttggtttctcccactaggaaaaacagtaccagttttactgtcatcttgcaacagcacacatatcagtgcttcagagatgatttggaaatttgatgtgaaagaataataagatcaagtctttattcaaaagttaatgcagtagctgcattttattcactgattataggcaaatcagtactttgcctactgtctgttttcttcatctcataagtaattgcaaaaatgagattttctggttgattagacttctgagccagtcctttgtaaatcacaccgctctccttttccttataatctttcattattaagagccactaattgtgtgtgtgtgttttttttgtctctgccccccccttttttttttttcatttttaggatctgcagaaaaggctgtcttggaacaatttggattccctttaactggaacagaggcaagggactacatggaaggttgtcttggcactgaacggagaaaggtcaaaaggaagataaaaagtttgttccagagaaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggaccatgctggctgctgtgttgagagcccgctggggacaaggaccagtgaggaggccactgcaagaatccaggagagagatgatggcggctcagaccagcgcagtggcctggttgaacttgggatatatttcgaaggtagagccaacaggatttccggccggattggatgtagggtgtgagaaacagagaggaggcaaggatgacgtcaagggttttggcctgagcagctggaaatccagccgggcacccccgtgggggctgttgagtggttttaactgtctcctggggcctgtgggtgaagctgagacagagaccgaagggaggggctgagccctacccctggctctgtggctcagggaataggctgcacatactgattattccattacccttt

SEQ ID NO: 332665 - DNA, 2855 bp, Homo sapiens
  misc_feature (1777)..(1777): n is a, c, g, or t
gggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaatggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctaggacctgaattggtcttggaggcagcttttagaaatcctctatgtagttcctgtccacatgcactatatatttgtttcttctttctcctctcatgaatctgctcgtttctctacttctgtctacgtagaagcactcagcaactagtttctgctcattaaatgtgttctatatactaggctcagtgctttacatgtgtttgtcttaccngagtttcacttttccaaagtagtcatccacaaagtatgaggcagacagatctaagagaagaaagacagctgaggtagattcaaatcttttctgacatggatggtggctttttactcagaaatatatacctatttccatgggtatttgtgggcctgaggcatgcttggcaagaagagtctggtttctcgtctgctatgcaagccaaagggactttaatgttctttgaattgaaccctccttagctctgtggaaagagacagtcaggaatatttgggaattagacggcaatactttgtggggtttattagagcccatgcttgcctccagagatacagttcttttagtgaccagatactgccaaattgatgtgttcttgctttccaggtgagctttttgttcttaagattaagaaacctatgaaggatctgcagccaggcatggtggctcaggcctataatctcagcactttgggaaatcgaggtgggtggatcgcttgagcccaggagtttgagaccagcctgggcaacataatgaaaccctatctttacaaaaaaatacaaaaattagctgggcgtggtggtgcacacctgtagtcccagctactcgggaggctgaaatgggaggattgcttgagcctggcaggtcaaggctgcgatgggacatggtcatgccactggacgccagcctgggccacagagggagaccctgtctcaaaaaaagaaaagaaaaaagaaaaaggtctgcccacaaaatcactagcttattatttgcttcctgtgtgcctgcttgtctacctagcatagtaggccaaaggtccaaaggcatttagcattcctaggggaaattgtggctgtttttctgagccagatctcttgatttgggtttacacggagtcctttcatggactatcctgagtattgtcagtaaaacgtcttggggcataagaacttgtctgaatctgtcatacataccactgctgtcttttccgagtggtattacaagaaagatttttgtggtgtgtttgttctaagagaaatgccaaggctttcagataaagataagatgataatgattgaca

SEQ ID NO: 332666 - DNA, 405 bp, Homo sapiens
gaatctctgagtcagtttattatttttggcagttgaatttaaattcattagaacagagtgggatggcttataagtacatttcagcaatgcattaaataagtatttttcagaaaaaatttgcgaactgttagcacaaattggcatcactaatatggctgctttgtttttaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatct

SEQ ID NO: 332667 - DNA, 3081 bp, Homo sapiens
  misc_feature (2003)..(2003): n is a, c, g, or t
gggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaatggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctaggacctgaattggtcttggaggcagcttttagaaatcctctatgtagttcctgtccacatgcactatatatttgtttcttctttctcctctcatgaatctgctcgtttctctacttctgtctacgtagaagcactcagcaactagtttctgctcattaaatgtgttctatatactaggctcagtgctttacatgtgttgtctcacaatgactctctgaggtaaatacactatccccattttacctgtgagaaaattgaggcttagagagcttagtgtcttaccngagtttcacttttccaaagtagtcatccacaaagtatgaggcagacagatctaagagaagaaagacagctgaggtagattcaaatcttttctgacatggatggtggctttttactcagaaatatatacctatttccatgggtatttgtgggcctgaggcatgcttggcaagaagagtctggtttctcgtctgctatgcaagccaaagggactttaatgttctttgaattgaaccctccttagctctgtggaaagagacagtcaggaatatttgggaattagacggcaatactttgtggggtttattagagcccatgcttgcctccagagatacagttcttttagtgaccagatactgccaaattgatgtgttcttgctttccaggtgagctttttgttcttaagattaagaaacctatgaaggatctgcagccaggcatggtggctcaggcctataatctcagcactttgggaaatcgaggtgggtggatcgcttgagcccaggagtttgagaccagcctgggcaacataatgaaaccctatctttacaaaaaaatacaaaaattagctgggcgtggtggtgcacacctgtagtcccagctactcgggaggctgaaatgggaggattgcttgagcctggcaggtcaaggctgcgatgggacatggtcatgccactggacgccagcctgggccacagagggagaccctgtctcaaaaaaagaaaagaaaaaagaaaaaggtctgcccacaaaatcactagcttattatttgcttcctgtgtgcctgcttgtctacctagcatagtaggccaaaggtccaaaggcatttagcattcctaggggaaattgtggctgtttttctgagccagatctcttgatttgggtttacacggagtcctttcatggactatcctgagtattgtcagtaaaacgtcttggggcataagaacttgtctgaatctgtcatacataccactgctgtcttttccgagtggtattacaagaaagatttttgtggtgtgtttgttctaagagaaatgccaaggctttcagataaagataagatgataatgattgaca

SEQ ID NO: 332668 - DNA, 3211 bp, Homo sapiens
  misc_feature (2133)..(2133): n is a, c, g, or t
gggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtagattcttcaagtttacactcctagcatcattgtttcttctctctctcaaccttcacctatggctggtcttgaatttctgggttcaagtgaccctcctgcctcagcctcctgagtagctgggattacagggactacatggaaggttgtcttggcactgaacggagaaaggtcaaaaggaagataaaaagtttgttccagagaaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaatggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctaggacctgaattggtcttggaggcagcttttagaaatcctctatgtagttcctgtccacatgcactatatatttgtttcttctttctcctctcatgaatctgctcgtttctctacttctgtctacgtagaagcactcagcaactagtttctgctcattaaatgtgttctatatactaggctcagtgctttacatgtgtttgtcttaccngagtttcacttttccaaagtagtcatccacaaagtatgaggcagacagatctaagagaagaaagacagctgaggtagattcaaatcttttctgacatggatggtggctttttactcagaaatatatacctatttccatgggtatttgtgggcctgaggcatgcttggcaagaagagtctggtttctcgtctgctatgcaagccaaagggactttaatgttctttgaattgaaccctccttagctctgtggaaagagacagtcaggaatatttgggaattagacggcaatactttgtggggtttattagagcccatgcttgcctccagagatacagttcttttagtgaccagatactgccaaattgatgtgttcttgctttccaggtgagctttttgttcttaagattaagaaacctatgaaggatctgcagccaggcatggtggctcaggcctataatctcagcactttgggaaatcgaggtgggtggatcgcttgagcccaggagtttgagaccagcctgggcaacataatgaaaccctatctttacaaaaaaatacaaaaattagctgggcgtggtggtgcacacctgtagtcccagctactcgggaggctgaaatgggaggattgcttgagcctggcaggtcaaggctgcgatgggacatggtcatgccactggacgccagcctgggccacagagggagaccctgtctcaaaaaaagaaaagaaaaaagaaaaaggtctgcccacaaaatcactagcttattatttgcttcctgtgtgcctgcttgtctacctagcatagtaggccaaaggtccaaaggcatttagcattcctaggggaaattgtggctgtttttctgagccagatctcttgatttgggtttacacggagtcctttcatggactatcctgagtattgtcagtaaaacgtcttggggcataagaacttgtctgaatctgtcatacataccactgctgtcttttccgagtggtattacaagaaagatttttgtggtgtgtttgttctaagagaaatgccaaggctttcagataaagataagatgataatgattgaca

SEQ ID NO: 332669 - DNA, 1229 bp, Homo sapiens
gggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctattctctggagaaaaataaaatggaaattgtactta

SEQ ID NO: 332670 - DNA, 3027 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgacaggaaaggccatgtgaggacatagggagaaagcagccaccattggcaagccaagagagagccctcaccaggaacgattggaccagcaccttgatcttggattttctagcctccagaactgtgagatacaaatttctgttgtttaagccacacagtctgtgatattttgttacagcaaccctaatagactgagagagctcctgagagcttcactcacagaatcaattgtattcttacctggtgaagatccattctaagacttattggctgtttggaagtgatagcaaataaaagccaccttgaactgggtctgatgcagcattcttaccaaacttcaaacctggactagttcatccttatgcattgaggcttttttattcgtgttcgtttgtttttaccagttaactatcaacataaatttcatttataatattgtatgttcagtgttccaaaaaactggtcctaccaacatagtttggaatgactccattataagatggtgactgcctgtatcaaatctttactgcctttttcaaattcttaccatttttataaaaaggagtcacactactcaatctatacatcagtgttaaatatgatttttactaattttttttttttttaccaacactatcttaaaaaatctgacagcatagagcagtgattaaaggcatttgcttcagggtcaaatatagttacactgctgttttttggacaatttgttattttgaaccattgtttcttacctttataaaatgagcataagataatgttcttttaaggtgagtatgagatacaaatgagaaaagcaataataataaagattcaacaatggaaactgctatttacattatgattgttataattagaaggacaaactgtaatttaacgttcctatagtaataaaatggcatctacagagcaaatctaaacagacttaatcttcatataacaattcatcccagataatttgaattgaccataataacatgtttgaaaggaggctgaaataaaacagggtttgctcttttcaactctttagccaagactttttttaaaaaaaactggtatataaatgctttgtatttcctttcaagtttgaagggaaaataaatataatacttaatagattttcaagtatctctttagacattctcttgtttaggcttgtactaatccattcattcagggtttgactgttgggtgaacttctttgccctattcccagctgtgagaggcaattctccaggtttctaagctttagacctacgcccttctctgatgaggttaattagggtttgggctgaaacccagattcctatatatgtggatagagtgatgtagaagtactttatgataataaatataaatgaaatttagattttaatttagaaatagaaaacatttaggcaactcactgaatcaaaaataaatatagacaaatttaattaatatatttatttattatattttcctgggttgggctttggcctctatttcatatattttgtttatttttcaggatgttctgggataatgtagtccaggttctagttctgcctttgtcacttactagccatctagtcatataatgctgaaaaatatattatgtagctctaagataaattcaacgtacctgcatagcactattcaacatacttgcacagtattattgtcaatatgtagtctaacagataagaaaccactgtgaaaatagtaaaccattataaaaaatgatgttttataatgatacatctttgcacttctaatattattgctttaaataaatgtggtatatattcagcatacagccaaatttacaaaattttatctttttaattttatgtcatatataaagaaccttaatgccaaaataatctttatagtgatgactcgacatcccaaaaatgtgggacccaacagggacattaataaagagataaagcaggctctgtgccgacttgttagaatttggtacgtggcaaatgtgcagtcacacggccttaaacctcccctgggaaactgctcaaacatttgcattcccacaatgtatttattcaggaaatactcttttcctgagaaaaatctggctctcaaacctctccctgagattatgcaagttctccattggggaaatacagttggaaatctagtaaagaatgtttattaacaaaaatccatttgcagatcctagttattctcaatattttgtggatttacaattgagaatactacttgcaaaaagtaaacttcaaaaaaaggaaatagaaagctatcagaattcctgtagagtttgttgttccccttctcctccaacatagttttattctaatgttttctttattcattttctttggtattagtgtgctgtaaactcacccaaaatgaaaaacaatcaaaataaaataaaacaaaatgaaagcacatcagttaaagataaaacaaaacaaaaaacaggctgccaggttttagtggacagaagggtaggccccctggagatcagccaaattgagtggatggaagtaatcaacaacaagaggacaacaacattagccactgctgagcagaaaattagaaagattcttcaatttatttttttttcttttctggttgtcaggttttgtctctcctgtcttccactggtacaccataaatcagcagctaaaatgaaatttccttcttttagacatggcaaagtactcattgagcttagagattaatagtaaaacttt

SEQ ID NO: 332671 - DNA, 1182 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgttacaaaagaaggaacaaatgatggttggaagaatgcggctcatatttaccaagtctttctgaacgccttctgcattcatgcatccatgttctttctaggattggatagcatttcatgcctatgttaatatttgtgcttttggcatttccttaatatttatatgtatacgtgatgcctttgatagcatactgctaataaagttttaatatttacatgcatagtaaaca

SEQ ID NO: 332672 - DNA, 480 bp, Homo sapiens
  misc_feature (39)..(39): n is a, c, g, or t
aatgacgttcatattgtaaaattgtagttgcacgaaatnctagtcagctacattgaacaaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgtta

SEQ ID NO: 332673 - DNA, 482 bp, Homo sapiens
aatctgccttttcactaccataaggaggccttctttctgtctctctcccctggcttcttactatgattccttcaatacttgtactattagatattgtgtttgctctgcctcactgtctagattacaagatttttttgaagaaaaacataatgtactatacagtttatagacttcccccaccctcagcattgaccacagtgttaaacatataaagatgactcacattttttatttatcaattttgtgatccacagttacaaaagaaggaacaaatgatggttggaagaatgcggctcatatttaccaagtctttctgaacgccttctgcattcatgcatccatgttctttctaggattggatagcatttcatgcctatgttaatatttgtgcttttggcatttccttaatatttatatgtatacgtgatgcctttgatagcatactgctaataaagttttaatatttacatgcatagtaaaca

SEQ ID NO: 332674 - DNA, 3919 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332675 - DNA, 4295 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaaaaaaaaaaaaaaaaaaaaaaaaagaaaaaaaaaaaaaaaaaaaaaaaaaagaaagaaaaaaaaaaagggggggaaaagaagggggaaaagggggggggggggctgtggcaaaaatactctgctcacgagggacgatctttaaacaaaccatgttttggagaagaaaagttatcaattagttggatttaaaaataataagggggcgtcttgtaaaaaaaatcatgtgtagtagtaaattctgtagttgtcgattagagaaaaaactctggggggggaaattaaggaaacattaagagtataacagcgggtgaaacaatcttatatgtgtgggtacaaaagtagagtgttgacgaatgtggtatttttaatataggca

SEQ ID NO: 332676 - DNA, 1344 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgtta

SEQ ID NO: 332677 - DNA, 4159 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttatgaagtcttgctctgttgcccaggctggagcgcagtggcacaatctcagctcactgaaaccttcgccccctgggctcaagctagccagtcttttagtaaacatttagtcaacaaatctgcaattataacggtacagtacgggtggctggcaagatggccgaataggaagagctccagtctacagctcccgcagagatcaacgcagaaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332678 - DNA, 4041 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgacaggaaaggccatgtgaggacatagggagaaagcagccaccattggcaagccaagagagagccctcaccaggaacgattggaccagcaccttgatcttggattttctagcctccagaactagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332679 - DNA, 4072 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgacaggaaaggccatgtgaggacatagggagaaagcagccaccattggcaagccaagagagagccctcaccaggaacgattggaccagcaccttgatcttggattttctagcctccagaactgaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332680 - DNA, 4120 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttatgaagtcttgctctgttgcccaggctggagcgcagtggcacaatctcagctcactgaaaccttcgccccctgggctcaagctagccagtcttttagtaaacatttagtcaacaaatctgcaattataacggtacagtacgggtggctggcaagatggccgaataggaagagctccagtctacagctcccgcagagatcaacgcagaaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332681 - DNA, 1117 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttggtaagaatcttgtggattttattgcttccaggaaactattatcatgctaacaatgaagtggattgtgtattagaagtatgtctttaaatatatatatatacctgcgttgttgcttaataatgtgtttgttgaaatactgagattcaaattgtttaagacatttaatctcataaaagcaacaattttcctaatct

SEQ ID NO: 332682 - DNA, 331 bp, Homo sapiens
ggtatataaatgctttgtatttcctttcaagtttgaagggaaaataaatataatacttaatagattttcaagtatctctttagacattctcttgtttaggcttgtactaatccattcattcagggtttgactgttgggtgaacttctttgccctattcccagctgtgagaggcaattctccaggtttctaagctttagacctacgcccttctctgatgaggttaattagggtttgggctgaaacccagattcctatatatgtggatagagtgatgtagaagtactttatgataataaatataaatgaaatttagattttaatttagaaata

SEQ ID NO: 332683 - DNA, 318 bp, Homo sapiens
cccaatgtgactgcatttgaaggtaaggttttagggggtaattaacataaatgagataataaatgttcaatcctaattcagtaggattgatggccttaaagaaggccttagagaaaagatatctttctttctctccatgtgcacacaggacaggaaaggccatgtgaggacatagggagaaagcagccaccattggcaagccaagagagagccctcaccaggaacgattggaccagcaccttgatcttggattttctagcctccagaactgtgagatacaaatttctgttgtttaagccacacagtctgtgatatttt

SEQ ID NO: 332684 - DNA, 1151 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgttacaaaagaaggaacaaatgatggttggaagaatgcggctcatatttaccaagtctttctgaacgccttctgcattcatgcatccatgttctttctaggattggatagcatttcatgcctatgttaatatttgtgcttttggcatttccttaatatttatatgtatacgtgatgcctttgatagcatactgctaataaagttttaatatttacatgcatagtaaaca

SEQ ID NO: 332685 - DNA, 1949 bp, Homo sapiens
  misc_feature (654)..(654): n is a, c, g, or t
  misc_feature (1665)..(1665): n is a, c, g, or t
atcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggtattgcagtacttccaggaacggtgcacctacagtacgggtggctggcaagatggccgaataggaagagctccagtctacagctcccgcagagatcaacgcagaaggtgggtgatttctgcatttccagctgaggtatctggctcatctcatcgggactggttagacagggggtgcagcccatagagggcaagccaaggcagggtggggcattgtttcaccagggaagtgccagggattggggaactccctcccctagccaggggaagccaagaggaactgtgccctgaggaatggtgcactctagcctagatacgatgcttttcccatggtcttcacaacccacagacccggagatttcctcaggtgcctaccccaccagggccctgggtttcaagcacaaaacaggaagccatttgtgcagacaccaagttagctgcaggagtttttttcataccccagtggtgcctggaatgccagtggacagatctgttcantcccctggaaagggggctgaagccagggagccaagtggtctagctcaacggatcccaccacctacagagcccagtaagctaacattcattggcttgaaattcttgctgctagcatagcagtctgaagtcgccctgggacgcactagcttggtagggggaggggcgtccaccattactgaggcttgagtagctggttttcccctcacagtgtaaacaaagccccagggaagttccaactgggcgaagcccacaacagctcagcaaagcctctgtaaacagactgcctccctagattcctcctctctaggcagggcatctctggaaaaaaaggcagcagccccagtcaggggcttatagatcaaactcccatctccctgggacagaacacctggggaaaggggaggctgtgggctcagcttcagcagacttaaatgtacctgcctgccagctctgaagagagcagaggatctctcagcacaccactcgagctctggtaagagacagactgcctcctcaagtggatccctgacacctgtgtctcctgactgggagacaactcccagcaggggcggatggacacctcatacaggacaattccagctggcatctgccaggtgccctctgggacaaagcttccagaggaagtaacaggcagcaaactttgctgttctgcagcctctgctggtgatacccaggcaaacagggtctggagtggacctcaggcaaactccagcagacctgcactgcagcagaggagcctgactttcagaaggaaaactaacgaacagaaaggaatagcatcaacatcaacgaaaaggacatccagacagaaaccccatctgaaggtcaccaacatcaaagaccaaaggtaggtaaatccatgcagatgaggaaaaaccagcgcaaaaaggctgaaaattcccaaaaccagaacacttctcctccaacagatcacactccttgccagcaagggaacagaactggacggagaatgagtttgatgaattgacngaagtaggcttcagaaggtggataataaactcctccaagctaagggagcatgttctaacccaatgcaaggaagctaaaaatcttaaaaaaaagattatagaaattgctaactagaataaccagtttagagaagaacataaatgacctgatggagctaaaaaacacagcatgagaacttcgtgaagcatacacaagtatcaatagctgaatcaatctagcagaaaaaaggatatcagaggtagaagattgacttaatgaaatgaagtgtcaagacaagattagag

SEQ ID NO: 332686 - DNA, 3862 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgactctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332687 - DNA, 3865 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaatctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332688 - DNA, 4027 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttactttacagtacgggtggctggcaagatggccgaataggaagagctccagtctacagctcccgcagagatcaacgcagaaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332689 - DNA, 3950 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332690 - DNA, 3880 bp, Homo sapiens
attcccaactgccagtgatctctgaagcggactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332691 - DNA, 3297 bp, Homo sapiens
ctgctacgcttttttgaccaagaactacagttactcatggaaatattaccttacaattatatttaaagattcactgtttgctaatttaacatagcaatgtgaatgaaattgccagaagtctgcttttttaactgttgtacgcttcatgagtccaaatatgagattgtgacaatgtttatctattttaattggctgtatttttttccagcgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctcttttctctttctctttttctctggtttttttttttttccattttgttttgtttgttatgtttttttagacagggtcccactctgtcacccaggctggagtgcagtggtgcaatcacaggtcactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332692 - DNA, 846 bp, Homo sapiens
ctagaaacatacgtaccgtgactacatcgataaagttacatcatgctcacaggacagcatgtatgtggttgactcagctaatcaacacgggtgacttgtgggagcattatgatactgctcgaggctactgcgtgttacgcttcagagtcagagctgtagagccatgcaagacgggtactgtgcgccgtttgagaaatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 332693 - DNA, 225 bp, Homo sapiens
ctactggagctgtgagaagggggccactgccctccagaagtgagaatgacagaaccactagcagtttgcatcctgaacctggaaaagccacaggcactcaactctattctttttttttttcctttgagacagagtctcaccgtgtagcccaggccagagtgcaatggcacgatctcagctcactgaaacctctgcctcccaggttcaagcaattctcctgcctca

SEQ ID NO: 332694 - DNA, 546 bp, Homo sapiens
caaagcaactcactctagcttatatggtgagtaagcggtgcagctgggattcatgcctgggtccgtccacccctgaggccccagcttgtgactcctgtgctgtgctgtccgccagccacagcacggctcacggcacaccgtgagtgccacggcatggctcatggcacatggtgagtggccccttcattcctagaaggcagtcttgtgtggtagagcactgagccgggagtcaagagacatgggttccaaatccagcggtcattcccattgttctgtgattgtgggcaagtttcttactatcttgggttcccctcgaagcctcattttccccattacatgaagggttagattctataaactgtagttctcttccagctgtaagattcagggaattgaatgtacctcgtaatgcattggtgagggtgctgccagagagtggaagatggtgggaatggcctagaccagagcaggttcatagccaatggtggttatgcagattaagggcctagtagcaggggccatagccctgctactcacagatacgct

SEQ ID NO: 332695 - DNA, 3270 bp, Homo sapiens
ggggcctctggccgcctggctccaacatcaagcaccgggctccgagtggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacagggagtaaactctgtctcccccggtctggtctcgggctgatgagcatgttgtggttcctgcacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaaggactccccctcagacctccaaagggcaacagaagagtattaataaacgtgaaaacttaaa

SEQ ID NO: 332696 - DNA, 3226 bp, Homo sapiens
ggggcctctggccgcctggctccaacatcaagcaccgggctccgagtggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacagggagtaaactctgtctcccccggtctggtctcgggctgatgagcatgttgtggttcctgcacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccgctccgtcggcactaccaccctgctccatcatcactacgtccagctccaacggcactggtgccccattccatcggcactaacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaaggactccccctcagacctccaaagggcaacagaagagtattaataaacgtgaaaacttaaa

SEQ ID NO: 332697 - DNA, 1055 bp, Homo sapiens
ttggcaggacactagtgcttggcaggacactagtgcttggcgggacactagtgcttggcaggacactagtgtttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaaggactccccctcagacctccaaagggcaacagaagagtattaataaacgtgaaaacttaaa

SEQ ID NO: 332698 - DNA, 464 bp, Homo sapiens
gcctctttcatctgacccatcctgtccccgccagtgctgctgggaggcctgagccgggtcttctcaccccattccagggacctgtggcattgggagacatcccattctatttctcccgggaagaatggggcaccctggaccctgctcagcgggatctcttctgggacataaagcgggagaactcccggaacaccaccctgggtaagcacccagggcctttgggtccaggctggccgcccccgattctgctggaacttcagtcttgtttcccaccccatccttagctggttccaaagcaggctctccctaggtcttgccaggagcctgagtaactcctttcttggctgatgatcagtttttgtgcgtttccacatgcagcatgggacggcgccggcgctgcccagccctgcagttgctctaagggcaacttctcctttgagtctcacaacctagtgcatggaagt

SEQ ID NO: 332699 - DNA, 3209 bp, Homo sapiens
ttcctgttcattggccatcggtcatggagaaggcgggctcagtggacgaacggctttctgggagctggggaatgcttgcgtacgtagtttcccagcgagccccgcgaggacttccggcgccgggagctcgcggcggaagtgggatctcctgggccgtagtgggcgttgtgtgtttcgggggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaaggactccccctcagacctccaaagggcaacagaagagtattaataaacgtgaaaacttaaa

SEQ ID NO: 332700 - DNA, 3318 bp, Homo sapiens
cccgaatagtaggagtgcgtcaccggtgttatttcagtcacgagggcgtcgcgttgtccgtttagttacattgtcagtggcccgacacttcgaatggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacagggagtaaactctgtctcccccggtctggtctcgggctgatgagcatgttgtggttcctgcacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaaggactccccctcagacctccaaagggcaacagaagagtattaataaacgtgaaaacttaaa

SEQ ID NO: 332701 - DNA, 2048 bp, Homo sapiens
ctgatacaggaaaccagtcttcttcaaaggtgatgagaatgccttgacaagatgatagggaccagcactgtacatttgttcccaagggaatactgcaacatgcaggcacagcccttggtcacctaatacatgtatttgtgaaattccatgggttcccttaagttgggagctaaaagggttagctttgggttagctgtggttttcactagtttctgcttgacaggatcagaagactgccgagacagatactgctatgctgaatttttcatgttcatctcagggactcactgcatactattttttaactacatgtgctattcagagttaggagatcttggatgggactccaaaataaatgatttaagaaattccataccttacattaggaccagagcttgtagtaaaggatgttgtgatatggttttgacccagaaggatgcttttgggtatcatcctcaagaatgtctgcaaaaggttttcagtgaagacaacaaagaatacctgtgctttcactgggaggaggaatgagcctgatggtagtagtgccttttgcttgtggtacatgtagccaaaagagctctgtgatgccaacaaacattgagaaaggtaatctttggtcactgccagctggattggccagtgcaccttgtattcagtactctatattgaagtatctgtcctttgactgtatgcggtgcttattgtacttagtttttagggccctgaaagctttctttgcacttactggttcaaatcccaacatcaactacatgttaaaagcagtcaggaaaagaatgatttggcttattttaagctttaagcataacatactgacagagcttatgaatatatatacaataaaatttatataataatataaatatataactagcttacacatcttaaaatttagatccagcacacaaaataacattttaaagctaaatactttggattttatgcatgagggaactacaaactgcacactttccacaagggagggaataaatacttttttctgtgtccttggagtgtgggtgggattcgtggatacatttctctggttcactatttcaatgatatgaaggagcctcatgttgcagcacagaagatttttcatcgttggaagttaaggttagttcaccttcattgattcctccctacactggactaaagcatttaatctagaaacacttaggtctctatatagcttgtcataatctctatgcatagaaaggggctttctagaacctgtcagcatattgtgaaatatctcctatatcaactgataataagaaatcagaattgcttaattgtggcattaataaagtatcacctagattgaactaagcaggaaaattttagatgagagtttaccatcacaagcaataaacacacaacagtccctgaatcctaaaaaggtggagttcttgatggtattagtgcgtatcttcaaattatttgctctctggaaagatgctgataaaattttgtccactaccatagtatccctgctggatgggaaccatatctttacaatagactctccacccattggcaaggtgatagctgtaaggacagtcaccttgcaagtgggcatgaagctgttaattttttttttttttttgtcaactgaggtttttctgctatggttctgaacccatttacctgatagactgggttatatattccccagttaacccactactgggttaagtgaccctaatgatattagtagccacttaattattttcaagcattctgcctaggacatcgtttcataaaattaaggtttaacagactgaatcccaacattagtagtataactaaattctctcaggagctttttatgaatgccttagtagtactttggcttcttgaagaggagctaatgccataaccctttttaaatcatccatctgcagctgggcatggtggctcacacctgtaatcccaacactttgggatgctgaggtcggcggatcacagggtcagcagttcaagaccagcctggccagcatagtgaaaccctgtcttcactaaataca

SEQ ID NO: 332702 - DNA, 393 bp, Homo sapiens
ctttctctgtgggggcccaggctagaccctcctgagactggctgaggcctgacctcaaaggacagcaaatgctggccctcagattccaggggccgccccttcaggtcattgccaccaggaagagctcacacatgcgcactttccctgctgagcttcagccttctttgtttcctaataatttcctctgattctacttcataggtaattttaacaactgctggggtgaactggaagagttccagttgctaaatttaagagccatggtaatttctcaatgtgtaataggaactgcaatgatataaaaacatatataggtaatttaccacacagggtttagctgtgccagggagattctcttattgttgcactttacagaggcacagagaggggagt

SEQ ID NO: 332703 - DNA, 2875 bp, Homo sapiens
  misc_feature (1030)..(1030): n is a, c, g, or t
caagggttgtgcttgggaaaagttggacctgttaattaaaagtaaaatatttccaaatcaatttggaaatgacttgaagtgtgagggaaagggattcataaaatttaggtataggaggccctggaaaaggacatttatcctagagggcacagggggtgtctctctggtaggggaagggtggggaggtggctttataagagtggtctgccttctccctttctcacttttcctcaccccttttctctcttcccccgcaaagctgcttccctgccctgccaccacctttagtgctttgtcttttttcccctttgcccatgctcagctgttaacccataaagacttcgttgattttgtgtgcatagtggatggtatggctgcattaatcccttcactgcctgtataccctagaatttgtccctgacactgacttcagagcatggtttgagttcatctcccatcattccccattgttgtgcttcccgtaaaaactgccagctttatcatttcccctggctctgcccacactgcatgtgtaggggctgaactatgggcaagtgtctgaccacccaggcaggtgagtgtgtgtcttctaatgcaagtctgtttctgtttttgttgtctttttaaactcatagaattgattgttgaaaataaggccatcaactgctaaaacaactactaaaataattctttttaatataaaaataactttgtcaaattcactttcagaagatttttcagatgtccctgttgagagcattgttctagataggttatatttgaaactgtgagcagaagcatgtgagcccatctgctatgatgagtaatagtcattgaggcctgaaacatacagtgctttaagcatgactgttattacaaagcatgcttctcccaccccacccaccccctcaaagaaggtagccattgaaacataaggatgatagatagaatgtattacttcaaatctaactcttagctggtggaggatttagtaatttagttgctttaggtcttgtaaaagctcctgccnctaactttaggagatgagaagtttgacccttaatgttcttgatatttttttagatcaactccacaatttactgtgatccaatccatctgctttctatctgttgtgctctatgattggttctcatttaccttcatttctgtattctactttccttaaactttaaggaaatctaatcacaactcctgaagacttacctttcttagatctgaaacttaagatcagtgtattataaaatggaatctcttagcagtcacagctacataaattgggattttaatagttgtctgtgctttgaattcttttcctttaaatgtctgtttcttttatgtaaagtttttcagtttggggaacgtgtagtcttcccctcccttttaatttctcaccaggatctaaaccccccttctctgtgaagcttaaatctgcattgtactctccctcctccccccccatcagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaaaaacactcaaaaaacttta

SEQ ID NO: 332704 - DNA, 555 bp, Homo sapiens
cataatcctattatctggaataatatggaaagaatcatagaatcttaaccatcaggtaaggtataattcaccttttaattgagctaatgactcgattgtgtacttgaagaaaaattacatggtataaagacttctttgttgttttttagggcattggccctaaactgtgatgctccattggaagtcagagtgatacgcagttttaaagggaggaagatcagcaaatatgctcctgaagaaggcaacagatatgatggcatttataaggtgctctatctggcatgacatcttgtttgtcattcttcctgggctttcaaggcagggttgttgcaaggaactactgtgggtgggctcgaggaaacagtagccatcttatattgctactttttctggaaattgaacagatgcataaagcaaactcttaacttcagcactttacttttaaggcttatttcgagttcctaggggcagagttgggttaaggtttttttttttaaaatgtaagtgtatgttctctataataaagccatttaagtaactggctgttgtataact

SEQ ID NO: 332705 - DNA, 207 bp, Homo sapiens
tgtcagaggaccccaaaagccatttctctacggttcgctttgtagctgtgctttggttttacatctgcagagttttgagggctgtgctgacctttgagaggatttgaaattgcttcatattgtgatcctaaattttatattcactatattccctaaagtataccttaataaatattttatgatcagaaaaacactcaaaaaacttta

SEQ ID NO: 332706 - DNA, 3385 bp, Homo sapiens
agctggcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataagatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaatggcttgtgttggtcgtacgagagaatgtactattgtcccttctaatcattatggacccattcctggtattcctgttggatcaacttggagatttagagttcaggtgagcgaagcaggtgttcacagaccccatgttggtggaattcatggtcgaagtaatgatggggcttattctcttgtactggctggtggatttgcggatgaagtcgaccgaggtgatgagttcacatacactggaagcggtggtaaaaatcttgctggtaacaaaagaattggtgcaccttcagctgatcaaacattaacaaacatgaacagggcattggccctaaactgtgatgctccattggatgataaaattggagcagagtctcggaattggagagctggtaagccagtcagagtgatacgcagttttaaagggaggaagatcagcaaatatgctcctgaagaaggcaacagatatgatggcatttataaggtggtgaaatactggccagagatttcatcaagccatggattcttggtttggcgctatcttttaagaagagatgatgttgaacctgctccttggacctctgaaggaatagaacggtcaaggagattatgtctacgtttacagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaaaaacactcaaaaaacttta

SEQ ID NO: 332707 - DNA, 1666 bp, Homo sapiens
cataatcctattatctggaataatatggaaagaatcatagaatcttaaccatcagggcattggccctaaactgtgatgctccattggatgataaaattggagcagagtctcggaattggagagctggtaagccgtggtgaaatactggccagagatttcatcaagccatggattcttggtttggcgctatcttttaagaagagatgatgttgaacctgctccttggacctctgaaggaatagaacggtcaaggagattatgtctacgtttacagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaaaaacactcaaaaaacttta

SEQ ID NO: 332708 - DNA, 2646 bp, Homo sapiens
  misc_feature (801)..(801): n is a, c, g, or t
atcccggggaggtggctttataagagtggtctgcttccctgccctgccaccacctttagtgctttgtcttttttcccctttgcccatgctcagctgttaacccataaagacttcgttgattttgtgtgcatagtggatggtatggctgcattaatcccttcactgcctgtataccctagaatttgtccctgacactgacttcagagcatggtttgagttcatctcccatcattccccattgttgtgcttcccgtaaaaactgccagctttatcatttcccctggctctgcccacactgcatgtgtaggggctgaactatgggcaagtgtctgaccacccaggcaggtgagtgtgtgtcttctaatgcaagtctgtttctgtttttgttgtctttttaaactcatagaattgattgttgaaaataaggccatcaactgctaaaacaactactaaaataattctttttaatataaaaataactttgtcaaattcactttcagaagatttttcagatgtccctgttgagagcattgttctagataggttatatttgaaactgtgagcagaagcatgtgagcccatctgctatgatgagtaatagtcattgaggcctgaaacatacagtgctttaagcatgactgttattacaaagcatgcttctcccaccccacccaccccctcaaagaaggtagccattgaaacataaggatgatagatagaatgtattacttcaaatctaactcttagctggtggaggatttagtaatttagttgctttaggtcttgtaaaagctcctgccnctaactttaggagatgagaagtttgacccttaatgttcttgatatttttttagatcaactccacaatttactgtgatccaatccatctgctttctatctgttgtgctctatgattggttctcatttaccttcatttctgtattctactttccttaaactttaaggaaatctaatcacaactcctgaagacttacctttcttagatctgaaacttaagatcagtgtattataaaatggaatctcttagcagtcacagctacataaattgggattttaatagttgtctgtgctttgaattcttttcctttaaatgtctgtttcttttatgtaaagtttttcagtttggggaacgtgtagtcttcccctcccttttaatttctcaccaggatctaaaccccccttctctgtgaagcttaaatctgcattgtactctccctcctccccccccatcagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaaaaacactcaaaaaacttta

SEQ ID NO: 332709 - DNA, 1621 bp, Homo sapiens
cacccaggctggagtgcagtggcgtgatctcagctcactgcaagctccgccttcttggttcactccattctcctgcctcagcctccccagcagctgggactacaggcacacgccgccacgcccagataattttttgtatttttagtagcgatggggtttcactgtgttagccaggatggtgtcgatctcctgaccttgtgatccgcctgcccggcctctaaatagaagacattaaatgtgactgaaacatttttattgctaaataatagatggatatattttgggatacatgtgaaattttgatatgttcatataacatataataaatcagggtaattggaatgttcatcactataaacatcttttatgctgggaacatttgaattattctctactagctgttttgaaatacacagtagatgaattttattagcatattatgaactgctaacttttctttccttatccttggatactgttctagaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaaaaacactcaaaaaacttta

SEQ ID NO: 332710 - DNA, 3257 bp, Homo sapiens
agctggcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgaatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaatggcttgtgttggtcgtacgagagaatgtactattgtcccttctaatcattatggacccattcctggtattcctgttggatcaacttggagatttagagttcaggtgagcgaagcaggtgttcacagaccccatgttggtggaattcatggtcgaagtaatgatggggcttattctcttgtactggctggtggatttgcggatgaagtcgaccgaggtgatgagttcacatacactggaagcggtggtaaaaatcttgctggtaacaaaagaattggtgcaccttcagctgatcaaacattaacaaacatgaacagggcattggccctaaactgtgatgctccattggatgataaaattggagcagagtctcggaattggagagctggtaagccagtcagagtgatacgcagttttaaagggaggaagatcagcaaatatgctcctgaagaaggcaacagatatgatggcatttataaggtggtgaaatactggccagagatttcatcaagccatggattcttggtttggcgctatcttttaagaagagatgatgttgaacctgctccttggacctctgaaggaatagaacggtcaaggagattatgtctacgtttacagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacaacagtgcaggtatgaacaacagtgcaggtatgaacaacagtgcaggtatgaacaacagtgca

SEQ ID NO: 332711 - DNA, 2473 bp, Homo sapiens
agctggcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgaatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaatggcttgtgttggtcgtacgagagaatgtactattgtcccttctaatcattatggacccattcctggtattcctgttggatcaacttggagatttagagttcagagtctgggtttcaccatattgcccagactgatcttgaatccctggggtcaatttctcctgccttagtttcccaaagtactgggattacaggtgagcgaagcaggtgttcacagaccccatgttggtggaattcatggtcgaagtaatgatggggcttattctcttgtactggctggtggatttgcggatgaagtcttgacagagttatgaatatgaatattgtggagtctgtccagataccgggtggaagactggttttgatcagtttaagaagtattctaaactgttctagatgtacgtatttattagaattccttctcatagaatacatactaaagattaagtttcgtaataccttgtttaaaaaatatgtagaccttaatattggattaacaaaaggtgaaagtaaatttaagggttttggaccaataacactttaagaccatgagatgtttatttgtggcttttaatccaagggaaaaacaaagtataaataattgacttctataatacgaatttagtagacacaaaacatcattgtctaagttgtctaaactaattaaaatgatcttgcattaaagaatcactattttgctagtgttagtaggattaattgtgcactgatagttacttttcttaatttgtttcaagtactgaatcagatagagacaataatatccatataaatttgtagctgctatagaagtaattggagagcttttggcttttttttttt

SEQ ID NO: 332712 - DNA, 1077 bp, Homo sapiens
agctggcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataagggtctggctctgtcacccaggctgtagtgcagtgacgtgaacacggctcgctgtagccttgacctgctggggtcaagtgatcttcctgctcggcctcccaaagtgctgggatacaggcgtgagccaccatgcccggctaacttagatctttgatatcttgattagttctttctttacatatttaatattttgctttatttatggtagctttgtttttgatgcaattattatatatggttatcttctaaaatagtaatctgtttgctgatatagagaaatgaaattgatttatttggcttttgtaaccagcaaccttttcaaatctaataaattgtgtagaaataaaaa

SEQ ID NO: 332713 - DNA, 422 bp, Homo sapiens
ttaacataactgatttctcaacgtttgttttgcgtcttgtagggaatggcttgtgttggtcgtacgagagaatgtactattgtcccttctaatcattatggacccattcctggtattcctgttggatcaacttggagatttagagttcaggtatgttttaacttgggcttagttgaaaggggagaattggctatcagattatagcaatgttaatgtctgttgattgtaagtgaacctaacacatgacattcacttgttagaatgaaatatattttttaggatgggtgtactcttcctggaggttaacaaaggaacatacatcacagaattgggcattagctatgcattttcatcactttgtttttactgttctgttatagttgtggtagtaaccattattgttaagctttctaaacagcctt

SEQ ID NO: 332714 - DNA, 3645 bp, Homo sapiens
agctggcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgaatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaatggcttgtgttggtcgtacgagagaatgtactattgtcccttctaatcattatggacccattcctggtattcctgttggatcaacttggagatttagagttcaggtgagcgaagcaggtgttcacagaccccatgttggtggaattcatggtcgaagtaatgatggggcttattctcttgtactggctggtggatttgcggatgaagtcgaccgaggtgatgagttcacatacactggaagcggtggtaaaaatcttgctggtaacaaaagaattggtgcaccttcagctgatcaaacattaacaaacatgaacagggcattggccctaaactgtgatgctccattggatgataaaattggagcagagtctcggaattggagagctggtaagccagtcagagtgatacgcagttttaaagggaggaagatcagcaaatatgctcctgaagaaggcaacagatatgatggcatttataaggtggtgaaatactggccagagatttcatcaagccatggattcttggtttggcgctatcttttaagaagagatgatgttgaacctgctccttggacctctgaaggaatagaacggtcaaggagattatgtctacgtttacagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaaaaacactcaaaaaacttta

SEQ ID NO: 332715 - DNA, 3285 bp, Homo sapiens
ccccgcgaggcgcggggtgcggggcccagtcccgccgaatggtggggagtgggtccctgccagccccaactggaggtgcgccgcgcggggtcagaagtgagggcgtccggagcgcaaatatctcgccgtttgtatttgttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgaatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaatggcttgtgttggtcgtacgagagaatgtactattgtcccttctaatcattatggacccattcctggtattcctgttggatcaacttggagatttagagttcaggtgagcgaagcaggtgttcacagaccccatgttggtggaattcatggtcgaagtaatgatggggcttattctcttgtactggctggtggatttgcggatgaagtcgaccgaggtgatgagttcacatacactggaagcggtggtaaaaatcttgctggtaacaaaagaattggtgcaccttcagctgatcaaacattaacaaacatgaacagggcattggccctaaactgtgatgctccattggatgataaaattggagcagagtctcggaattggagagctggtaagccagtcagagtgatacgcagttttaaagggaggaagatcagcaaatatgctcctgaagaaggcaacagatatgatggcatttataaggtggtgaaatactggccagagatttcatcaagccatggattcttggtttggcgctatcttttaagaagagatgatgttgaacctgctccttggacctctgaaggaatagaacggtcaaggagattatgtctacgtttacagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaaaaacactcaaaaaacttta

SEQ ID NO: 332716 - DNA, 2400 bp, Homo sapiens
agctggcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgaatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaatggcttgtgttggtcgtacgagagaatgtactattgtcccttctaatcattatggacccattcctggtattcctgttggatcaacttggagatttagagttcaggtgagcgaagcaggtgttcacagaccccatgttggtggaattcatggtcgaagtaatgatggggcttattctcttgtactggctggtggatttgcggatgaagtcgaccgaggtgatgagttcacatacactggaagcggtggtaaaaatcttgctggtaacaaaagaattggtgcaccttcagctgatcaaacattaacaaacatgaacagggcattggccctaaactgtgatgctccattggatgataaaattggagcagagtctcggaattggagagctggtaagccagtcagagtgatacgcagttttaaagggaggaagatcagcaaatatgctcctgaagaaggcaacagatatgatggcatttataaggtgctctatctggcatgacatcttgtttgtcattcttcctgggctttcaaggcagggttgttgcaaggaactactgtgggtgggctcgaggaaacagtagccatcttatattgctactttttctggaaattgaacagatgcataaagcaaactcttaacttcagcactttacttttaaggcttatttcgagttcctaggggcagagttgggttaaggtttttttttttaaaatgtaagtgtatgttctctataataaagccatttaagtaactggctgttgtataact

SEQ ID NO: 332717 - DNA, 1698 bp, Homo sapiens
agctggcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgaatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaggggaggggagggaatgaggcagctctaggatctatactgtagctaataaaatgtaaaaacacctg

SEQ ID NO: 332718 - DNA, 5350 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332719 - DNA, 1041 bp, Homo sapiens
ttctttattgagttactatgtgtaacggtcattcaaataatagaaatttttggatgatatttcataagcaaaacaatcatcaaaatgttctaaaggtgaaagttgaatgcataatttaatacaagtttgtttactgttttgttagaaatgaaaaaactagatcaaaatgtcctgggcttagattctaatttgaccattgaattattttgtataaagacaaacccactggaggtaggtaatatcaacaatttaaatgttttaaaatttggcctgctgacaagttaatggtcatttggaagttagagtttttgtgctgagaggttgctttcgatgattctgatacacttgagagtcttttgtaaacctaatagctttctgcgagtttgttgctcttgacaaagtgtgccctttttgggttgggggttacttcgattgcaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaaggtacacaggtcaaacaggattggaggggtgctaatgcaaggttggtgttaagatctagtttttagtgatcttatgtagaaaatacaggaatcaaggtaattggccttttagcactgtaattaactggatctcagaacccagtttgctgtatgtgaagttgttacatcgtctgccagcatttccccacacatttgatgttcttctagaaattaatactttttttaatcaccgtattctgtgtattaacatttattgaggaatacattccagatgatggctgttaaatgatgctatatctggaatcccagattgctcagggatgggggagggattctagtatcttattacaaaactatagttgaggggtgtagtacttattttcttgactatgttctgtcctgtagctgattacaaactattttcaaattcttttacttgtacattatgct

SEQ ID NO: 332720 - DNA, 7335 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttgatttgtggttatagtattttgtttataatggtaagtttgcatattcagttgagttttttttacttgaatttttatcagtgccattaaatgtctgtgtttagtatcaatgaaaatgaacctaaatataacaaagaaagcatatgtggctaggatgtccccctaacatgtcttcctttgttaatgcaggaattccttagtttccttgtaacgctgtcctctgagtttgtgtgtgcatgtgcgtgtttgaagtaccaccttgggttttcacctgaaattagaaaaatcgtagttaatttgagaaaatgttacaaattcatcatggctgtaggcacttatttctgttattgagtagtggtgagaattcctattggtacagctgtagggccagaagagggagtattgatgctttttaacttaaccagatgcagctatttttgtttgatgttaccaatgatagaaatcattttaaacaccttagtatctggtatttcaaatacgtagaagtctttaaaggtctttcgtggggagaaggacttttctttcataacaagagaatttcagatcagtgattacaagtggggcagtaacttgctaagagtttgcttcctggagagtagatctgtatgtgtgacatcacaggtaagccccaagaatttatttaatcagatttgttcagacgagttactgctgcctacgttagagttagatttcaaggcgagtcagcaaacccatcctttctgctcagtctcccgtactgttctcccaagttctttgttctgggagtcagaacccaagtgcaagaggagggcagaagagtctgatgctgttactttgcgatcctgctcttggtttccactgtccaggccatacaactctgtctactcccattagtatttaccaacaggtgttaaaggaaagctgaacaagcagcctactcaccgatctgctaggtggtcttccatgttcatggtggcttctgcagtttcattgagagtaacattgctgttaatacagatagatccagtagtagagacatcatcggtccaaaagactttgcatctcattagttgtccatagtgactaccaggaggtggctggcatctataacgtgtgggacgtttttatgtaaagaactgcctgtgttttttttttttttaaccaaagacactgaccatagattgacttatacttttataagtctaattgaaatacttggggtactatgaaaggactgttccttgagtggctacgattagaaaatcaggactaacaaacttttctttgtctggaagcatatatatttgtgatataattttaatatgtataattttggtttaataaatcaaatctatgacaaaagttgttctcatcaaagctaataattctgcaacttccaaaaaggactttgtaggaaaattaaaatacaaagaaaaataaaagccactagaaattttaagtctgtacagaaaagaacaggttaagacaatctgtacctctacagttggagaagcccttttgactcttccctgtattgttttgctactaggcaagtatgcagcatgttcttatgaagataattttgtcatactttgtatatttcttaaactttgaaaaattgggtttctctaaatgtaatttttggcaaaatgttttaaagttccccattgagttccaaggatttttaaatgaatgtgtttacatatacttttcataagagaaccctagaaaattaactatagtaatactctgcgttttaactcccagtattcattgtcagctggaaaacctaggcaaatttggcacaggggctgaacatggggtactttttttcttttttggagacagagtcgctctgttgctcaggctggagtgcagtggcgtgatctgggctcactgcaacctccgcctcctggtttcaagcaattctcctgcctcagcctcctgaggagctgggattacaggcgcccacc

SEQ ID NO: 332721 - DNA, 5729 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggtaagcctttgtatttaagttctggttgttaccacagagttggccttcttgcagttttgggttgtattcatatttgttaagagagaagttttgtcctatgtgttggaattcagtgcacatttcattgtcttttttctttatttcaagagaaaagatatatctgatgtgctcagcaaacctttggaggttaattagcagcatgactaacttagccattgctgccagtcaccttcaaacaagtatcagtagcttcatgatacattttgtatttctttgcattggatgatgtttttgtatattaaaaaaaaaagagttttagatgttttagtatctcttatgtagaaagtgtgattctctttcaatttaatggattttataggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332722 - DNA, 6664 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttgatttgtggttatagtattttgtttataatggtaagtttgcatattcagttgagttttttttacttgaatttttatcagtgccattaaatgtctgtgtttagtatcaatgaaaatgaacctaaatataacaaagaaagcatatgtggctaggatgtccccctaacatgtcttcctttgttaatgcaggaattccttagtttccttgtaacgctgtcctctgagtttgtgtgtgcatgtgcgtgtttgaagtaccaccttgggttttcaccgatctgctaggtggtcttccatgttcatggtggcttctgcagtttcattgagagtaacattgctgttaatacagatagatccagtagtagagacatcatcggtccaaaagactttgcatctcattagttgtccatagtgactaccaggaggtggctggcatctataacgtgtgggacgtttttatgtaaagaactgcctgtgttttttttttttttaaccaaagacactgaccatagattgacttatacttttataagtctaattgaaatacttggggtactatgaaaggactgttccttgagtggctacgattagaaaatcaggactaacaaacttttctttgtctggaagcatatatatttgtgatataattttaatatgtataattttggtttaataaatcaaatctatgacaaaagttgttctcatcaaagctaataattctgcaacttccaaaaaggactttgtaggaaaattaaaatacaaagaaaaataaaagccactagaaattttaagtctgtacagaaaagaacaggttaagacaatctgtacctctacagttggagaagcccttttgactcttccctgtattgttttgctactaggcaagtatgcagcatgttcttatgaagataattttgtcatactttgtatatttcttaaactttgaaaaattgggtttctctaaatgtaatttttggcaaaatgttttaaagttccccattgagttccaaggatttttaaatgaatgtgtttacatatacttttcataagagaaccctagaaaattaactatagtaatactctgcgttttaactcccagtattcattgtcagctggaaaacctaggcaaatttggcacaggggctgaacatggggtactttttttcttttttggagacagagtcgctctgttgctcaggctggagtgcagtggcgtgatctgggctcactgcaacctccgcctcctggtttcaagcaattctcctgcctcagcctcctgaggagctgggattacaggcgcccacc

SEQ ID NO: 332723 - DNA, 5297 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332724 - DNA, 6667 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttgatttgtggttatagtattttgtttataatggtaagtttgcatattcagttgagttttttttacttgaatttttatcagtgccattaaatgtctgtgtttagtatcaatgaaaatgaacctaaatataacaaagaaagcatatgtggctaggatgtccccctaacatgtcttcctttgttaatgcaggaattccttagtttccttgtaacgctgtcctctgagtttgtgtgtgcatgtgcgtgtttgaagtaccaccttgggttttcacctgaaattagaaaaatcgtagttaatttgagaaaatgttacaaattcatcatggctgtaggcacttatttctgttattgagtagtggtgagaattcctattggtacagctgtagggccagaagagggagtattgatgctttttaacttaaccagatgcagctatttttgtttgatgttaccaatgatagaaatcattttaaacaccttagtatctggtatttcaaatacgtagaagtctttaaaggtctttcgtggggagaaggacttttctttcataacaagagaatttcagatcagtgattacaagtggggcagtaacttgctaagagtttgcttcctggagagtagatctgtatgtgtgacatcacaggtaagccccaagaatttatttaatcagatttgttcagacgagttactgctgcctacgttagagttagatttcaaggcgagtcagcaaacccatcctttctgctcagtctcccgtactgttctcccaagttctttgttctgggagtcagaacccaagtgcaagaggagggcagaagagtctgatgctgttactttgcgatcctgctcttggtttccactgtccaggccatacaactctgtctactcccattagtatttaccaacaggtgttaaaggaaagctgaacaagcagcctactcaccgatctgctaggtggtcttccatgttcatggtggcttctgcagtttcattgagagtaacattgctgttaatacagatagatccagtagtagagacatcatcggtccaaaagactttgcatctcattagttgtccatagtgactaccaggaggtggctggcatctataacgtgtgggacgtttttatgtaaagaactgcctgtgttttttttttttttaaccaaagacactgaccatagattgacttatacttttataagtctaattgaaatacttggggtactatgaaaggactgttccttgagtggctacgattagaaaatcaggactaacaaacttttctttgtctggaagcatatatatttgtgatataattttaatatgtataattttggtttaataaatcaaatctatgaca

SEQ ID NO: 332725 - DNA, 3262 bp, Homo sapiens
ctagaggatcccggatgtttccctttgtctccttttggagttgtacctgaattttattgtccaattttcatccgaatccactggggaatgggacgattttgcttttgtttcttggccaggaatcgcgtaatcctgaaagtcttgtgagaagacatggcgagcagcagagtcaagaacacaccacgatggcggagaaaggaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332726 - DNA, 2897 bp, Homo sapiens
aagtttgaaatagatgatgtccgatgttgagcagaattattctatgcgactcaactgcacgcagtcgctatggagaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332727 - DNA, 2619 bp, Homo sapiens
cgtctgtatgtaaaaggaggcgtagggatggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgattatgcccggcgtgatctaagagtaagacgagatctaagagacgacagggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332728 - DNA, 2257 bp, Homo sapiens
tcctagcctcgccagtgtcctagcctcgccagtgtcctagcctcgccagtgtcctagcctcgccagtgtcctagcctcgccagtgtcctagcctcgccagtgaggagacagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332729 - DNA, 2156 bp, Homo sapiens
taccaagaaaaagtttgtaggcaaacctttaggccctcctacagcacaggcggggccagactcctcacacattcccaatcgcaagggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332730 - DNA, 4228 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332731 - DNA, 1997 bp, Homo sapiens
agaaaatggaggcccaaacttcgtggctgtccaaaggctgtgtgacccgttgggcattggaaccagtccagccatctttgtcagtccgttgcttttacccctgtggtttagggcagtcagttttcttgcccttaaattatcaaaagccctttgattttattagtagtagaagttctagcttgttcccgctgccaaagtgtccttgtactgacaaatgtagaccagcagtgttcgatgcaattttcttcaaggaagaaaatgtgtctgctggccagtatggtagtcagcagtcacatttggcagccaagcacttagaatatatggttgatggtcctaaggaaatatctccgttttactttaaatgtaagtaaccacatatgggtagtggctaacgagtgggacggcacagatctgggtgttctcatttgttctccacgccccaggcatcaggtaaggtcaggttatgagtttaaactgtctgttatatttgtaaactctaagccccagcttggactggatgtacttataattatccatttggtctaacagtaagaacctgacctgtcattgtaaatggctacagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332732 - DNA, 3995 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcacacgggagagatgaaagggctgagaagaaggacggaccaatggccagagccctcgacacaggaaagtgtgaaacgccggcgaccgcggaggacgcgcgacaggggacgccgaggaacggccagggggcccgagcgggccgagggcc

SEQ ID NO: 332733 - DNA, 3763 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggcaaataacttcctgtggcccttcaaattgtcttctccacgaggtggaatgaagaaaaagaccacccattttgtagaaggtggagatgctggcaacagggaggaccagatcaacaggcttattagaagaatgatacaagggtgtggtaccatg

SEQ ID NO: 332734 - DNA, 1146 bp, Homo sapiens
  misc_feature (10)..(10): n is a, c, g, or t
  misc_feature (30)..(30): n is a, c, g, or t
  misc_feature (34)..(34): n is a, c, g, or t
cgcccggagntgcacggagagcggtgcccnttcnaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332735 - DNA, 3130 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaaggtacacaggtcaaacaggattggaggggtgctaatgcaaggttggtgttaagatctagtttttagtgatcttatgtagaaaatacaggaatcaaggtaattggccttttagcactgtaattaactggatctcagaacccagtttgctgtatgtgaagttgttacatcgtctgccagcatttccccacacatttgatgttcttctagaaattaatactttttttaatcaccgtattctgtgtattaacatttattgaggaatacattccagatgatggctgttaaatgatgctatatctggaatcccagattgctcagggatgggggagggattctagtatcttattacaaaactatagttgaggggtgtagtacttattttcttgactatgttctgtcctgtagctgattacaaactattttcaaattcttttacttgtacattatgct

SEQ ID NO: 332736 - DNA, 2682 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcgctgtaggttaaggcgctgtaggttaaggcgctgtgggttaaggcgctgtaggttaaggcgctgtaggttaaggcgctgtaggtt

SEQ ID NO: 332737 - DNA, 2607 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaggctgcgccaggaagcaaaggagagagagaaggagcgtatcttacaggaacatgaacaaatcaaaaagaaaactgtccgagagcgtttggagcagatcaagaaaacagaagtgggtgccaaagcattcaaagatattgatattgaagaccttgaggaattggatgcagattttatcatggctaaacaggttgaacaactggagaaagaaaagcaagaacttcaagaacgcctaaagaatcaaaaa

SEQ ID NO: 332738 - DNA, 769 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattactatatacagaaaaccccaaggactgcacacaaaactactcaaactcgatcaactgatcaactgaaagtagaaggatacaagtataacattcagaaattggttgctttctgttaccgcgttgcgcactg

SEQ ID NO: 332739 - DNA, 727 bp, Homo sapiens
gacctgctttcttttatgtgagtagtgttatttcttatgtgctatacaaataattgaaggctaattagcagtataactataaatagtaatgctgccagtctccttcagacaaaaattctataagaagtgtttaaatatattcggtaagtagcaggtttttaggcttttttgttttacaacaactaggatttgaaaagattataggtttgaggaatagtatgataatggttctcaaagcatggagtttagagtcgatggtctgggattagcattctggctttaacaatgtactgctaacataaattctctggcataatttctacttcccatgactgtcatgagattgcacataaaaagtgctgaataaacagtggctagtgttattaaccctttgttttctatgcaggtgtcacagatttatcagagcattgagttttctcgtttgacttctttggttccttttgttgatgctttccaactggaacgggccatagtagatgcagccaggcattgcgacttgcaggtaggtatgtgctgtaaggagacaggagaaggcccttgagggctagaaagacacataccttctgtttctcagcttttggtacagtgataccattttaaagtttactgagtgaacttttccagcttttgtatatgacattcttctgttactttttgacttcatgcttacttgtggatttaaccattgataatttaattttcaaag

SEQ ID NO: 332740 - DNA, 6721 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttgatttgtggttatagtattttgtttataatggtaagtttgcatattcagttgagttttttttacttgaatttttatcagtgccattaaatgtctgtgtttagtatcaatgaaaatgaacctaaatataacaaagaaagcatatgtggctaggatgtccccctaacatgtcttcctttgttaatgcaggaattccttagtttccttgtaacgctgtcctctgagtttgtgtgtgcatgtgcgtgtttgaagtaccaccttgggttttcacctgaaattagaaaaatcgtagttaatttgagaaaatgttacaaattcatcatggctgtaggcacttatttctgttattgagtagtggtgagaattcctattggtacagctgtagggccagaagagggagtattgatgctttttaacttaaccagatgcagctatttttgtttgatgttaccaatgatagaaatcattttaaacaccttagtatctggtatttcaaatacgtagaagtctttaaaggtctttcgtggggagaaggacttttctttcataacaagagaatttcagatcagtgattacaagtggggcagtaacttgctaagagtttgcttcctggagagtagatctgtatgtgtgacatcacaggtaagccccaagaatttatttaatcagatttgttcagacgagttactgctgcctacgttagagttagatttcaaggcgagtcagcaaacccatcctttctgctcagtctcccgtactgttctcccaagttctttgttctgggagtcagaacccaagtgcaagaggagggcagaagagtctgatgctgttactttgcgatcctgctcttggtttccactgtccaggccatacaactctgtctactcccattagtatttaccaacaggtgttaaaggaaagctgaacaagcagcctactcaccgatctgctaggtggtcttccatgttcatggtggcttctgcagtttcattgagagtaacattgctgttaatacagatagatccagtagtagagacatcatcggtccaaaagactttgcatctcattagttgtccatagtgactaccaggaggtggctggcatctataacgtgtgggacgtttttatgtaaagaactgcctgtgttttttttttttttaaccaaagacactgaccatagattgacttatacttttataagtctaattgaaatacttggggtactatgaaaggactgttccttgagtggctacgattagaaaatcaggactaacaaacttttctttgtctggaagcatatatatttgtgatataattttaatatgtataattttggtttaataaatcaaatctatgaca

SEQ ID NO: 332741 - DNA, 4545 bp, Homo sapiens
caatggatggtctcgatctcttgactcgtgatgtgcccccttggctcccaaagtgctgggattacaggcgtgagccaccgcgcccggtcaatcacaatctttttctgaagctagaaaacactgacagtactgagtggatagatgaagtcctgattctccaagtattcgtttaaacacagcccatttctcttactcccatgctttgatggaataatatttatgagtatagtgcaccatggtgatgtacacgttctgtcactagcacgccttaccgtaagattaaagagaagtgcttttctgcttaccaagtatcatttacaaacctaacagatttaaaactttgctctccatagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332742 - DNA, 5233 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332743 - DNA, 2911 bp, Homo sapiens
gtcggtaccatggatcccatcatcgcctgacagacagagatgtattacgtaatggcgactcaaagctgcgcggtggtctgttgatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332744 - DNA, 3261 bp, Homo sapiens
ttctttattgagttactatgtgtaacggtcattcaaataatagaaatttttggatgatatttcataagcaaaacaatcatcaaaatgttctaaaggtgaaagttgaatgcataatttaatacaagtttgtttactgttttgttagaaatgaaaaaactagatcaaaatgtcctgggcttagattctaatttgaccattgaattattttgtataaagacaaacccactggaggtaggtaatatcaacaatttaaatgttttaaaatttggcctgctgacaagttaatggtcatttggaagttagagtttttgtgctgagaggttgctttcgatgattctgatacacttgagagtcttttgtaaacctaatagctttctgcgagtttgttgctcttgacaaagtgtgccctttttgggttgggggttacttcgattgcaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332745 - DNA, 2493 bp, Homo sapiens
tacacaccacggaaagagaagggttcacgggaagagaagcagaagccccaggctgagcggaaggaggagaaaaaggcggctgcccctgctcctgaggaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332746 - DNA, 1704 bp, Homo sapiens
ggcgacctgaggatcacggcatcataaacgtgaatgggacagagtaaaaagacagggacagagatatcaagatcgggaggagaatgacgtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332747 - DNA, 4529 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaacgttcaagctgttgcttacttggtttgctctcctctactggctactatacctgttccttcaccagttcttattccacctttatcgctgtctcctcatcccacaccgggatggaaccgatttttctcttttatatttgcttatcatccttttcttagctggttcaa

SEQ ID NO: 332748 - DNA, 1559 bp, Homo sapiens
actggatttctttaattaaaaaaatccagtgtctcaaaaacttgtgaaaatgtgtttaaaaaacaaacggccagtgagcctgctacaccatttgcccatatgcctatgtaacttctgagaatctcacacaagacgagatgcaaagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332749 - DNA, 1333 bp, Homo sapiens
  misc_feature (63)..(63): n is a, c, g, or t
acccgcagcttgtcctccccagccaacaacatctgcttctacggcgagtgttcctactacctntccacggagcacgccctgtgcgggaagccagaccagatcgagggctcgctggcggccttcctgcccgacctgtccctggccaagaggaagacctggcggaacccttggcggcgttcctaccacaagcgcaagaaggccgagtgggaggtggaccctgactactgcgaggaggtgaagcagacaccgccctacgacagcagccaccgcatcctggacgtcatggacatgacgatcttcgacttcctcatgggaaacatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgaaccttcaggtattgagtaacacctttatcttggtatagaactgatacttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaa

SEQ ID NO: 332750 - DNA, 2402 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatattttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttgatttgtggttatagtattttgtttataatggtaagtttgcatattcagttgagttttttttacttgaatttttatcagtgccattaaatgtctgtgtttagtatcaatgaaaatgaacctaaatataacaaagaaagcatatgtggctaggatgtccccctaacatgtcttcctttgttaatgcaggaattccttagtttccttgtaacgctgtcctctgagtttgtgtgtgcatgtgcgtgtttgaagtaccaccttgggttttcacctgaaattagaaaaatcgtagttaatttgagaaaatgttacaaattcatcatggctgtaggcacttatttctgttattgagtagtggtgagaattcctattggtacagctgtagggccagaagagggagtattgatgctttttaacttaaccagatgcagctatttttgtttgatgttaccaatgatagaaatcattttaaacaccttagtatctggtatttcaaatacgtagaagtctttaaaggtctttcgtggggagaaggacttttctttcataacaagagaatttcagatcagtgattacaagtggggcagtaacttgctaagagtttgcttcctggagagtagatctgtatgtgtgacatcacaggtaagccccaagaatttatttaatcagatttgttcagacgagttactgctgcctacgttagagttagatttcaaggcgagtcagcaaacccatcctttctgctcagtctcccgtactgttctcccaagttctttgttctgggagtcagaacccaagtgcaagaggagggcagaagagtctgatgctgttactttgcgatcctgctcttggtttccactgtccaggccatacaactctgtctactcccattagtatttaccaacaggtgttaaaggaaagctgaacaagcagcctactcaccgatctgctaggtggtcttccatgttcatggtggcttctgcagtttcattgagagtaacattgctgttaatacagatagatccagtagtagagacatcatcggtccaaaagactttgcatctcattagttgtccatagtgactaccaggaggtggctggcatctataacgtgtgggacgtttttatgtaaagaactgcctgtgttttttttttttttaaccaaagacactgaccatagattgacttatacttttataagtctaattgaaatacttggggtactatgaaaggactgttccttgagtggctacgattagaaaatcaggactaacaaacttttctttgtctggaagcatatatatttgtgatataattttaatatgtataattttggtttaataaatcaaatctatgaca

SEQ ID NO: 332751 - DNA, 1982 bp, Homo sapiens
gacccgccccctacatccggggcctgggcggcagcagggccgccgcggggaggtcacgtggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagacgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagcaggctccaggagaaaaccaggcgtgcagggggtcc

SEQ ID NO: 332752 - DNA, 300 bp, Homo sapiens
cccctccgattaaattcaaaaagaaacagaatagaaatactattccaaagaaggcaaaataccacatacatcttatttgttctcacaggtaaacaaatggaaatctaagaaagatttactgattgtccagtaaggcaaagatttttgtagatatgacaccaaacacgttattcattaaagaaaacaattgagaaattgagtgttttgagtatttctttccatttttttttttttttttagagacagggacttgctctgttgacagagctagggtacagtggtgtgatcatggctcactat

SEQ ID NO: 332753 - DNA, 266 bp, Homo sapiens
ctgtagggcaggggtatcctgggccacgatggaagaaatgtcttgggccacgcgtaaaatataatagcaccaactatagatgatgagcttaaaaaaaagcggggggcaaaaaagctcataatgttttaagaaagtttacgaatttgtgttgggctgcattcaaagcatcctgggctgcgtgcagcctgtgggccacgggttggacaagcttggtccaggggatctctaataaaaaatgcacatctaatctctgactcagcaattct

SEQ ID NO: 332754 - DNA, 794 bp, Homo sapiens
ttttgtatttttagtagagatggggtttcaccgtgttggccaggatggtcttaatctcttgacattgcaatctgcccatcttggcctcccaaagtgttgggattacaggcgtgagccaccgcacccggcctgtggattttaattgaaaaaagatagtggtttttagcaaattacaactactggctcagaagtaataaatctaagcttcacatttattccatagaattatattgtttttcttataatgaacatataattcatatgtgatatatagcagtcatgttgttttattctctacaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332755 - DNA, 1386 bp, Homo sapiens
tcctgtttttaaagtttcaggggtgtgtctaattcttcttggtgctggtttatttaacagaagtcttagtttttggatattaatattgtggaaagttaacagagctgatgtctagctgatcaaactcaaagtaagctcttcagtttaaattttcgatgtgggcataaatcaagtaaaggtctaatttttaaaactaatttccagtattttttctaaacagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcctacatatatattcttgtcttttctgagtatatttactgtggtcctttaggttctttagcaagtaaactatttgataacccagatggattgtggatttttgaatattattttaaaatagtacacatacttaatgttcataagatcatcttcttaaataaaacatggatgtgtgggtatgtctgtactcctcctttcagaaagtgtttacatattcttcatctactgtgattaagctcattgttggttaattgaaaatatacatgcacatccataactttttaaagagtatgattcaacgtaatatttgctaatatgtgactgggttttcttggtttatgtaagacgataggtccctgttgaggatgtggaggtctggaccctcttccaggaaaaattctaacatacaattttgcgtatactataatttcaggaaatttattgtttcccaagctcatccaaggactctttaggtatgtatggatacctggctaagagtgtatgatgtaggggatgtaggagtgtcagaaatgttcaaaacatgatttctgttacctatacatgattcttatatcatctggcaataaaagctataacaaagtaca

SEQ ID NO: 332756 - DNA, 943 bp, Homo sapiens
  misc_feature (807)..(807): n is a, c, g, or t
  misc_feature (824)..(825): n is a, c, g, or t
  misc_feature (849)..(849): n is a, c, g, or t
  misc_feature (859)..(859): n is a, c, g, or t
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggggggcggcggtttctgagggtacttcagtgacagagagattccgagaacgntatggggttccgaatcnnatggtgggtttgaaactctcggtngagttaaaangactcgggggccaacgaacagaaacgggcccggtggggggccgaattttaaaaccttgttggccaacgtaaggaaccgggctga

SEQ ID NO: 332757 - DNA, 733 bp, Homo sapiens
  misc_feature (711)..(711): n is a, c, g, or t
  misc_feature (713)..(713): n is a, c, g, or t
ttttgtatttttagtagagatggggtttcaccgtgttggccaggatggtcttaatctcttgacattgcaatctgcccatcttggcctcccaaagtgttgggattacaggcgtgagccaccgcacccggcctgtggattttaattgaaaaaagatagtggtttttagcaaattacaactactggctcagaagtaataaatctaagcttcacatttattccatagaattatattgtttttcttataatgaacatataattcatatgtgatatatagcagtcatgttgttttattctctacaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtgtacggatnancgggatcctctagaacacta

SEQ ID NO: 332758 - DNA, 537 bp, Homo sapiens
  misc_feature (8)..(8): n is a, c, g, or t
attcaatntgcggtgagcatcagcatgaatgaaaatgggaagacacaaattgcatggtgaaataggtaaggaagtcatctattttatatgtatttacatttggtaaatgaagaaaaatacttttagaaattactgatagtttcctaaatctggttttaaattcagcaaatgtggtggttttaaattcagcaaatagttattgagcatctactataagctaggaaccattgtaagtgttttgtaagggctgacaatatagcaaggaacaaaacagacaaatttctgccattagagaacttatattcttgttaggaaaaaacagataaagttagtaaaacaaagtataatagatgatgataagtgctatggagaaaaataaagcaagaaagtggggggcgggcatggtggctcactcctgtaatcctaatggttttggaggccgaggcagaaggaccgcttgaggccaggagtttgaggttgcagggagctatgatcatgtgactgcactccagtttggcaagacgctgtttcagggga

SEQ ID NO: 332759 - DNA, 468 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagtgtgagtgcacctttctttccatttaatcaagtgcctcgactcgcttctgcctctgacaaagcagaagcctttcgccgagcccggcaaccgagccttagagatgaccaggcctagggccagggacaaggcgctttgtcatccggccctgagcttgtggagcagcactccttcgggtgtagaaatggcccagtccagcccgggtgacagaacatcggcggccttgaggtgaaaatgaaaaagaagtagaggaggagtggggaagtgggccgaggatgtttcccaggttagggtgcaagaagggcagtcttggtggagtcccgggacttggagaggggaaggcgct

SEQ ID NO: 332760 - DNA, 1619 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcctaaaaaaaaaaaacacacaacccagacaacacaaca

SEQ ID NO: 332761 - DNA, 1383 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332762 - DNA, 1523 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332763 - DNA, 1517 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332764 - DNA, 1716 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaatgtgagtgatgaattagcttattaattagtaaagaaacagtccacctctctctcacttttgaaatgcttattattttaatgacaataatgcagagagagagagtatttttgaatagacttaagttttccttcaactaatgtctccttggaggacagaaatacaactaaaccctctgtcaacgtggcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332765 - DNA, 1288 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaattaataagccaacatctgtcatgcagccatcaaaaatcttacagtaaagtcgacgcggccgcgaatttagtagtagta

SEQ ID NO: 332766 - DNA, 1082 bp, Homo sapiens
ctgtggatccctcgggctgctggaattcggcactttagacagagttatagagagatagagagagagtgtgcgagagaagtgtattgtgacagaccgttggtgcccccctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332767 - DNA, 1504 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagcatggtgaaataggtaaggaagtcatctattttatatgtatttacatttggtaaatgaagaaaaatacttttagaaattactgatagtttcctaaatctggttttaaattcagcaaatgtggtggttttaaattcagcaaatagttattgagcatctactataagctaggaaccattgtaagtgttttgtaagggctgacaatatagcaaggaacaaaacagacaaatttctgccattagagaacttatattcttgttaggaaaaaacagataaagttagtaaaacaaagtataatagatgatgataagtgctatggagaaaaataaagcaagaaagtggggggcgggcatggtggctcactcctgtaatcctaatggttttggaggccgaggcagaaggaccgcttgaggccaggagtttgaggttgcagggagctatgatcatgtgactgcactccagtttggcaagacgctgtttcagggga

SEQ ID NO: 332768 - DNA, 786 bp, Homo sapiens
tcctgtttttaaagtttcaggggtgtgtctaattcttcttggtgctggtttatttaacagaagtcttagtttttggatattaatattgtggaaagttaacagagctgatgtctagctgatcaaactcaaagtaagctcttcagtttaaattttcgatgtgggcataaatcaagtaaaggtctaatttttaaaactaatttccagtattttttctaaacagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332769 - DNA, 598 bp, Homo sapiens
cgaggatccccgatagctcgatcaaactcaaaattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332770 - DNA, 409 bp, Homo sapiens
tgaagtgcttaaacagttaactgaagaaaaatgtgagtgatgaattagcttattaattagtaaagaaacagtccacctctctctcacttttgaaatgcttattattttaatgacaataatgcagagagagagagtatttttgaatagacttaagttttccttcaactaatgtctccttggaggacagaaatacaactaaaccctctgtcaacgtgggtatgtatttttttactttctatttttcaattagttcttttatgttttttcttctagtcattgttaaagctaccaatggaccaagatatgttgtgggttgtcgtcgacaggtaatactttatatttgtatagtgcctgatgattgacaaagcagtttcatgtaagttattgtctctaattcttgaggcaagca

SEQ ID NO: 332771 - DNA, 1585 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332772 - DNA, 749 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaacaggcatacgggctcctcgcacctagcccagcaactcaaattcaccacctcggactcctgcgaccgcatcaaagacgaatttcagctactgcaagctcagtaccacagcctcaagctcgaatgtgacaagttggccagtgagaacgtcagagatgcagcgtcactatgctgactgtactacgcagcatgtcctacggccttgcaaccatcgagaatgcacacaacaggctgatcatcgttcaaaaggctgaacgcggcatcttgtgcccaggctccatgacctaacatctcacaagagcataaagcagaagagtcattgggagccattgacatggccaagcaggtcaccagatccccaagctgaactctatcatccgataacaagttcaagaccaacaacagacccagctgcaagccctgccctgcccttacaccaataca

SEQ ID NO: 332773 - DNA, 2185 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcctacatatatattcttgtcttttctgagtatatttactgtggtcctttaggttctttagcaagtaaactatttgataacccagatggattgtggatttttgaatattattttaaaatagtacacatacttaatgttcataagatcatcttcttaaataaaacatggatgtgtgggtatgtctgtactcctcctttcagaaagtgtttacatattcttcatctactgtgattaagctcattgttggttaattgaaaatatacatgcacatccataactttttaaagagtatgattcaacgtaatatttgctaatatgtgactgggttttcttggtttatgtaagacgataggtccctgttgaggatgtggaggtctggaccctcttccaggaaaaattctaacatacaattttgcgtatactataatttcaggaaatttattgtttcccaagctcatccaaggactctttaggtatgtatggatacctggctaagagtgtatgatgtaggggatgtaggagtgtcagaaatgttcaaaacatgatttctgttacctatacatgattcttatatcatctggcaataaaagctataacaaagtaca

SEQ ID NO: 332774 - DNA, 1671 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggtaaagggaagattattttgtacttattgaaatttaattttacttgaattatcttatatttaccttactgtttttcctttaatcaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332775 - DNA, 3106 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagggctctgtggatgccgaaagttggcatttctaagatatttcaggttgcatgaggacaagactgtatttgaagactaaaaaacattagaaaagccgaagtatatataagttgagtatcccttatccaaaatgcttgagccagaaatgtgttttagatttggctttttttttttcaggttttagaatatttgtgttgtactggttgagcatccctaattaaaaaaaatcaaaagtttgaaatgctccgatgagcattttctttgagcatcatgtcagcattcaaaaaatttcacattgtggagcattttggattttcagattaagaatactcagcctgtatttcctatagatgtaaacattgaaatagcttcatattgatttctcctcttattttttcaagtaacctcacttcttagccgttttttccttaattgttatattaatcctagtgttttgcctatcttcctaaatttgaagctctttgtaaaatcctgtgacaagtggtcagtaatttatatgattccgaaattgtattggcacgcagttttttaaactattaaaaagtaacttgggtcgggcggggtggctcatgcctgtaatcccagcactttgggaggctgaggtgggcagatcacgaggtcaggagatcaagaccagcctgaccaacatggtgaaaccccgtctttactaaaaaatacaaaaaaaaattagccgggcatggtggcacacacctgtaatcccagctacttgaggctgaggcaggagaattgcctaaaccagggaggcagaggttgctgtgagccaagatggcgccactgcactccagcctgggcgacagagtgagactccgtactccatctcaaaaaaaaaagtaactttatctttggtaacaacatcctgagagtgaggcagatctagtagattctaattttagccagataagccaagaaattatttagtatgattcaacctaatgtgtaatgtgttcagcatgtgcctgtcatgtagcaaaggcatgagtgatggttgctgggttttggggctttaaatttaaagcattttaataaaaatctctaaggggaaaccgtgcatttttctctactctcatgagcatttaacacattcttcccagaagctgtacatttcaaaataaatctgatgagcacacctttaaaatgcttccctttcctttccctaaaatgttcactaagggatttttctataaatgctttggtagcaattcccaaagtcactgtaccattgctgcctcaagctttgtgtgttagtcatttcacattttacactgagattacacaaaggggcatgcttttaaggagcaggtggaaatcactttgaattacttattttataagccattttgttagcatagagtttataatctgatatttgtgttctctctggagggtaaaaatgagtgtttggcttctaaatattaaactctcgttagagtgttattccgtttttaagtgttgatgtaatatcttttgttttacaaaactagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332776 - DNA, 1438 bp, Homo sapiens
ttagcctccagagagacacaatatcagagttataactctagtgctaacaaaatggcttataatctgatatttgtgttctctctagagggtaaaaatgagtgttattccgtttttaagtgttgatgtaatatcttttgttttacaaaactagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332777 - DNA, 1591 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagtatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggtaaagggaagattattttgtacttattgaaatttaattttacttgaattatcttatatttaccttactgtttttcctttaatcaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctccta

SEQ ID NO: 332778 - DNA, 2144 bp, Homo sapiens
ggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagggctctgtggatgccgaaagttggcatttctaagatatttcaggttgcatgaggacaagactgtatttgaagactaaaaaacattagaaaagccgaagtatatataagttgagtatcccttatccaaaatgcttgagccagaaatgtgttttagatttggctttttttttttcaggttttagaatatttgtgttgtactggttgagcatccctaattaaaaaaaatcaaaagtttgaaatgctccgatgagcattttctttgagcatcatgtcagcattcaaaaaatttcacattgtggagcattttggattttcagattaagaatactcagcctgtatttcctatagatgtaaacattgaaatagcttcatattgatttctcctcttattttttcaagtaacctcacttcttagccgttttttccttaattgttatattaatcctagtgttttgcctatcttcctaaatttgaagctctttgtaaaatcctgtgacaagtggtcagtaatttatatgattccgaaattgtattggcacgcagttttttaaactattaaaaagtaacttgggtcgggcggggtggctcatgcctgtaatcccagcactttgggaggctgaggtgggcagatcacgaggtcaggagatcaagaccagcctgaccaacatggtgaaaccccgtctttactaaaaaatacaaaaaaaaattagccgggcatggtggcacacacctgtaatcccagctacttgaggctgaggcaggagaattgcctaaaccagggaggcagaggttgctgtgagccaagatggcgccactgcactccagcctgggcgacagagtgagactccgtactccatctcaaaaaaaaaagtaactttatctttggtaacaacatcctgagagtgaggcagatctagtagattctaattttagccagataagccaagaaattatttagtatgattcaacctaatgtgtaatgtgttcagcatgtgcctgtcatgtagcaaaggcatgagtgatggttgctgggttttggggctttaaatttaaagcattttaataaaaatctctaaggggaaaccgtgcatttttctctactctcatgagcatttaacacattcttcccagaagctgtacatttcaaaataaatctgatgagcacacctttaaaatgcttccctttcctttccctaaaatgttcactaagggatttttctataaatgctttggtagcaattcccaaagtcactgtaccattgctgcctcaagctttgtgtgttagtcatttcacattttacactgagattacacaaaggggcatgcttttaaggagcaggtggaaatcactttgaattacttattttataagccattttgttagcatagagtttataatctgatatttgtgttctctctggagggtaaaaatgagtgtttggcttctaaatattaaactctcgttagagtgttattccgtttttaagtgttgatgtaatatcttttgttttacaaaactagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggttggtattgaattatttctactccaccaataagataaatgaattaaggaatta

SEQ ID NO: 332779 - DNA, 148 bp, Homo sapiens
cgcctactcggcaaacctcagccaccctcataaaagatggcacccaatgggtggggctggaacagaccattacatccaatgcaacccacagtcattcagctttgcctcgccccatctgccaccaatcaaccagaacagcgcctgcgcg

SEQ ID NO: 332780 - DNA, 749 bp, Homo sapiens
tcttctgtgtgggttctgtgctggtgtggttcttgccctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332781 - DNA, 146 bp, Homo sapiens
ggctaatcagctcggtacctttcaaagcatacatcccaccatgatcaggatcacccaaccttcaacaagatcacccccaacctggctgagttcgccttcagcctataccgccagctggcatctccgctttggaaaggtgccgagct

SEQ ID NO: 332782 - DNA, 573 bp, Homo sapiens
ggaaccggggaccacccggaaagtgtacatatgatcgacgcgaggcaatgagaatcacagccgctgaacaagcctgtcaagctgggacctgcatgattaaaagccttggccgaatgcagcgagccatcttcttcgtgcctgattaaggggcacctccaaccacctggaaaatgtactcacgccaattccttactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332783 - DNA, 2435 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332784 - DNA, 4065 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggctggctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcacttat

SEQ ID NO: 332785 - DNA, 4011 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggcacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggctggctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcacttat

SEQ ID NO: 332786 - DNA, 3090 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggaaaaaaaaaaaaaaaaaacggagaaaagaagaaaccaacaagaagaagaaagaaaaagcagaagaagaaaagacaacaaaaaaacaagaaacaagcaaaaaacaaacacgggtggggggccggcggccgcgcacaagacatgacatcaacccacagtgggggggccgcgcgcaccacacatggaaaacacagacagcgacaacaagagcacacagacagagcccggcgcgaaaaacaacgagggagagagcaacgcccaaaaacaaaagcccggagagaaacacaagagtgagaaaaaacacacagaggggatattaagaagaacaacaggaggagaaacaaacgaagcggagatacgcaaacgcaagcaaaataaaataccgcccccagacagaggaagacagcaaaaagacaaagaaaaagcaacagacgcaaacacaaagcaacaaaagacgacgaaaagtagcggaagaaaaaaacagaaagaagaagggagcggaacgagaaagcagtgagacgtagagaaagacagaaggcgaggagagagaaaggagaaagagaaagaccgaagaaagaaaggcaagcagaagcgagacaaacgaggagacaggaaagagagaaggacagaaggacgacagagacaaagcaaaaaaga

SEQ ID NO: 332787 - DNA, 2807 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
  misc_feature (2576)..(2576): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggaaaaaaaaaaaaaaaaaaaaaaaaaaaaaaaaaaaaaaaaaaaaaaaaaaaaaaaaaaaaaaaaaaaaacctcgaaactgggggaaaagccccatttttttttagatgagactgggaatagaaatatccaaacaaccttgngggggcttggtcaaatccgggaaaaccggaaaagcaaaatccaaaggttagaatctgatgtctaagctgggaatattgccgcaccccatgcactgccagtggcaatattcctgggggggtctggcaaagattggtgaggaaattatcaggaaaggaggggaaccttctgaaaggtttctaattaaccggacagttctgcaaacccgcaagagggagtgtggctttgcgtgg

SEQ ID NO: 332788 - DNA, 2706 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggaaaaaaaaaaaagctaatagaaactataattatggacgaaagactgttcaggtgataaaagactgatgaaagacatccctaactggtagtcaggacgcaggattcatcattgcgaacaagggctcatgaaaagtacaggaggttccctaatcagggatcggcttgaaaaggccttgtctaactgtgtcgtgaaattaagtaattgtgagtgcctttaggctgatcatgggccctgccagatttccccccattcgtgtcccattgtgggctt

SEQ ID NO: 332789 - DNA, 2315 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaccatccctggccccctccctggatgacattaaagaagggttgagctgg

SEQ ID NO: 332790 - DNA, 2403 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaagttactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332791 - DNA, 2335 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaagagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332792 - DNA, 2322 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
  misc_feature (2265)..(2265): n is a, c, g, or t
  misc_feature (2306)..(2306): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggtctcaaggcgtgctaagctgtctgacatcgcgagaaggactgactgtgtgcatgtttagagcataccatgttatcccccgagcaagtcacaaccttngctctaatgatgcaaatacaagctccctttatggaaagggngatcaccaaatactgc

SEQ ID NO: 332793 - DNA, 2245 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaagccgtgcataaggctgtgctgaccatcgacgagaaaggacaggaagctcgacggggtcccctatcagccagattcacac

SEQ ID NO: 332794 - DNA, 4012 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggctggctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcacttat

SEQ ID NO: 332795 - DNA, 2867 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcacttat

SEQ ID NO: 332796 - DNA, 2400 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcaggagggagccaacacgagaaaaggcgaacggaggcaaccaaggaatgtagaaaaacacagaacaacagaggaacagagagagtggcaacagcgacataaacacacaaccaaaaaagaaagcgagcacaacaaggaaacacaagagagaaagaaaacggaaaacaacggcaagaaggaccctttgtcttcttaatgattgaacaaaatacgagattcataacagaaggaggagagaaaggaaagaagcacgcccagaagtagactgcctctcgctcctcaacccctcccc

SEQ ID NO: 332797 - DNA, 3058 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaagttactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggaaaaaaaaaaaaaaaaaacggagaaaagaagaaaccaacaagaagaagaaagaaaaagcagaagaagaaaagacaacaaaaaaacaagaaacaagcaaaaaacaaacacgggtggggggccggcggccgcgcacaagacatgacatcaacccacagtgggggggccgcgcgcaccacacatggaaaacacagacagcgacaacaagagcacacagacagagcccggcgcgaaaaacaacgagggagagagcaacgcccaaaaacaaaagcccggagagaaacacaagagtgagaaaaaacacacagaggggatattaagaagaacaacaggaggagaaacaaacgaagcggagatacgcaaacgcaagcaaaataaaataccgcccccagacagaggaagacagcaaaaagacaaagaaaaagcaacagacgcaaacacaaagcaacaaaagacgacgaaaagtagcggaagaaaaaaacagaaagaagaagggagcggaacgagaaagcagtgagacgtagagaaagacagaaggcgaggagagagaaaggagaaagagaaagaccgaagaaagaaaggcaagcagaagcgagacaaacgaggagacaggaaagagagaaggacagaaggacgacagagacaaagcaaaaaaga

SEQ ID NO: 332798 - DNA, 3933 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaagttactggaacctatgatctgaagagcgtcctgggtcaactgggcatcactaaggtcttcagcaatggggctgacctctccggggtcacagaggaggcacccctgaagctctccaagagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggctggctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcacttat

SEQ ID NO: 332799 - DNA, 2187 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaagagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332800 - DNA, 3770 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggctggctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcacttat

SEQ ID NO: 332801 - DNA, 2335 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332802 - DNA, 2368 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332803 - DNA, 2381 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332804 - DNA, 2447 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggaaacaatcagattacaaaagaaaaaaaagagcaaaacaacgtatggtggtcgctcgagctgggaaaagttataacccgg

SEQ ID NO: 332805 - DNA, 3569 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggctggctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcacttat

SEQ ID NO: 332806 - DNA, 3546 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaagagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggctggctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcacttat

SEQ ID NO: 332807 - DNA, 1718 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcaccctcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332808 - DNA, 2404 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaagggtaaggttgctcaaccagcctgagctgttcccatagaaacaagcaaaaatattctcaaaccatcagttcttgaactctccttggcaatgcattatgggccatagcaatgcttttcagcgtggattcttcagttttctacacacaaacactaaaatgttttccatcattgagtaatttgaggaaataatagattaaactgtcactgtatatgtagaatatataatgcttagaactatagaacaaattgtaatacactgcatgggatagtttcatggcatactttacacgactctagtgtcccagaatcagtatcagttttgcaatctgaaagacctgggttcaaatcctgcctctaacacaattagcttttgacaaaaacaatgcattctacctctttgaggtgctaatttctcatcttagcatggacaaaataccattcttgctgtcaggtttttttaggattaaacaaatgacaaagactgtggggatggtgtgtggcatacagcaggtgatggactcttctgtatctcaggctgccttcctgcccctgaggggttaaaatgccagggtcctgggggccccagggcattctaagccagctcccactgtcccaggaaaacagcataggggaggggaggtgggaggcaaggccagg

SEQ ID NO: 332809 - DNA, 2265 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaagagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaataaaatataataataataattataaaataaaaaaaattaaaaaataaaccttttatatacaatatatacacctattcatttcaaacactctacctcttcttcaattaatcaaaactttctcatccttccacaaaacacccctaaaatagttacttcaaataatattacagcgctctttcttacccacttcattcaata

SEQ ID NO: 332810 - DNA, 1978 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgacttcgacggacgcattcagacgaagaggggcgtttggtattgggttatggcagggggtttatattgatatggtggtgagaattgatg

SEQ ID NO: 332811 - DNA, 1691 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatgctgccatccttcctgtacagcctgcagtaccgtgagcaaaataagc

SEQ ID NO: 332812 - DNA, 1737 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
  misc_feature (1703)..(1703): n is a, c, g, or t
  misc_feature (1715)..(1715): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttacagtcacgatacgtgagaaggtctcaaggaaaatgtgattgtcaggagctgcagaacacagttttgtctgtgatacatctcttaaggcaatgaggaccttgagcaggcacgagagagactcactgncagtacacgtanggcatgtgacgtagctgtacac

SEQ ID NO: 332813 - DNA, 1326 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcatctccgctttggaaaggtgccgagct

SEQ ID NO: 332814 - DNA, 418 bp, Homo sapiens
  misc_feature (7)..(7): n is a, c, g, or t
  misc_feature (9)..(9): n is a, c, g, or t
  misc_feature (22)..(22): n is a, c, g, or t
tcgtcantntcgtgcagcggancgcgacttgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332815 - DNA, 568 bp, Homo sapiens
gggacagggaccaccgtaaagggccatatgataaacgaggcatgtacatccaccctgttaagcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332816 - DNA, 2388 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaagtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 332817 - DNA, 2485 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaagcctgcccccactaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacattacaaaaccacccattcctccccacactcatcgcccttaccacgctactcctacctatctctccctttttaaccgataatgcaacttcgatgcgaaagaacaacagaaagccgacgaccaacccgccagccgccgacacaagcgacccacaggcgcgaagccccagacccacacaaggccccggagaccgcaacgccccaggcccgacagacgcccacacgcacgccccgcaggcagacgacagaagccacccaaacaccggggggggcggcgccaccaccacacccgcggggggcgacacacgacaccgagcaggccagacagagcccagcga

SEQ ID NO: 332818 - DNA, 2784 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaataaaatataataataataattataaaataaaaaaaattaaaaaataaaccttttatatacaatatatacacctattcatttcaaacactctacctcttcttcaattaatcaaaactttctcatccttccacaaaacacccctaaaatagttacttcaaataatattacagcgctctttcttacccacttcattcaata

SEQ ID NO: 332819 - DNA, 2736 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggaaaacaacccacccacaacgccacaacaaaaaccccgtgcgcgcagcgcacgcgagcaccccgacaaacccctacaaaaacccccggccaaaggcagcccgcgccccaaacgccacctcacaccaccgcccaccgcgcccccgcaaaaaccagaggaacaacaaaccacagggtgggaacccccaccatgtaaaacgcgcgaggacacccagcgcgtccacacaccccggagcagctcgagggcaaaccgcgacaacccaccagcggaaccacgaacgacccatacacccacccccccctg

SEQ ID NO: 332820 - DNA, 2702 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggaaaaaaaaacaacaacaacacacaacacaacactgttcggccgaacgcgaccccgaaaaagctgctagaaacaatcgtgtgcaccacggcccaaaagggacgtgaaacggggcacagcggagtccacagagaaacccgggggcaaggaaacgggcggagatacacacccgaaaagaacccccgggagaaacaaggaggttagaaaaaagtccaagggggtccagagcgcacagggagcatcacaaggggccaaggaaccagacaaac

SEQ ID NO: 332821 - DNA, 2514 bp, Homo sapiens
  misc_feature (510)..(510): n is a, c, g, or t
  misc_feature (512)..(512): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (533)..(534): n is a, c, g, or t
  misc_feature (539)..(539): n is a, c, g, or t
  misc_feature (543)..(543): n is a, c, g, or t
  misc_feature (563)..(563): n is a, c, g, or t
  misc_feature (567)..(568): n is a, c, g, or t
  misc_feature (571)..(572): n is a, c, g, or t
  misc_feature (577)..(578): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (607)..(607): n is a, c, g, or t
  misc_feature (623)..(623): n is a, c, g, or t
  misc_feature (630)..(630): n is a, c, g, or t
  misc_feature (637)..(637): n is a, c, g, or t
  misc_feature (639)..(639): n is a, c, g, or t
  misc_feature (647)..(647): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (666)..(666): n is a, c, g, or t
  misc_feature (691)..(691): n is a, c, g, or t
  misc_feature (698)..(698): n is a, c, g, or t
  misc_feature (702)..(702): n is a, c, g, or t
  misc_feature (708)..(709): n is a, c, g, or t
  misc_feature (711)..(711): n is a, c, g, or t
  misc_feature (719)..(719): n is a, c, g, or t
  misc_feature (731)..(731): n is a, c, g, or t
  misc_feature (733)..(733): n is a, c, g, or t
  misc_feature (750)..(750): n is a, c, g, or t
  misc_feature (765)..(765): n is a, c, g, or t
ctttaccattcttccatggaagaagacaaaattcatctgagtgtagaaactaactatgctatggctcaggcccctctgggtatttctcctcaggaactgctcacctgtggggagagtgacttgtggtctgcttacccaaaataattcaatactcaaggctgggtggactctacagggcaatggtgtgactgaccagctctttcattgaagacatagaaagtacaagcagacccttctggcaggagctctaacatcaggcttccaatctagatttcatcagtaataaacattttggtttctatctcaggactcccaaatcgttcaattggacttgaactcagaagggaaactggatgttacttattgaactccaggtacacattatgtttcattaaaaaatatctatacaattatgacatcaagtagatgtcattggctactagaattatgtgggaaaacccttgtttgagtaagaggacttactatgtaaatatttttgaaaaagtggantnctggcngggngcagnggctcnngcctntaancccagcactttgggaggccnaggnnggnngatcnngaggtcaggagttcnagaccngcctgncnaacacggtgaaacccngctctantaaaaananaaaaattngcnaggcntggtggnacangcctgtaatcccagctatttgggangctgagncagnagaatnncntgaacccnggaggtggaggntncagtgagccgagatcangccactgcactccancctggactacaagagtgaaagcccgttctcaaaaaaaaaaaaaaaaaaaaaaaagtcctttcttcagtgaactctcatagggagggccaacagataaagtcagtaagagtgacactaacctggttaaggaagtgtgtggtttctcagagcacaccctgttctcatgctcctcccactcactgcccaatctttcctctccttcacttccaggctatctttagagaacttcagaatacaataatgaaaaccatgtctttgatcattaaacaccaaaaagtaactctgctactctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggaaacaatcagattacaaaagaaaaaaaagagcaaaacaacgtatggtggtcgctcgagctgggaaaagttataacccgg

SEQ ID NO: 332822 - DNA, 172 bp, Homo sapiens
caaaagcattatgctgaatgaaaaatagcctatctcaaaagtttacatactgtatagtttcacttatgtaaaattattaaaatgacaactttattgaagtataatttatataccacaaaattcacctgcataagtatataattcaatgccttttaatgaatttactaagttg

SEQ ID NO: 332823 - DNA, 634 bp, Homo sapiens
caattatatccagatcctcttgaacccacctgtctttttcaccttctttcatgtggcctctgccgttgaagtataaacaggtccagatgggaattttgtggatctgtagacagctttgcctaacctagagtgggtaagacagtcttggaaataaacactgacctatcattccgatgaaacagtcagtgggcctaaaaagaactattcctgggcacatatttattgggaacaaagtgctgggaatcatcaaaatgaatgagacttagccactaccttaagttgattgcaatctaacaagagagagacaggtacccaaatagcctaataacatcagattgaattctatacatgctcttttatcctgttcttctttaagggaaaacattatttgtttaataaaaattgtggacgcttgttatacaaattcaagcaatgcatacagaaaagaaaacagcagaaggtcaccaaatctcactacccaaaatataacaccatgttaacatttgatgagcaccattccaggcacttatgcagatatagatacagaaaaaaggacaggtagatagatgacaacctatattggtggataaaacgatgagcagaggttaaatagactcacattttatgcaatgtt

SEQ ID NO: 332824 - DNA, 296 bp, Homo sapiens
ctgcgtaattattctgcgtgctgcttgggagccagagggatagcccactgctgctcctaccatcaccaaaacacattgcccaggagcccaaggacccatacgctcacccagcacactgctgccactgctgacacccaagtaaaatgcctggaggcctaaggatcagcctgtccagactcactacctttggtgcacagaacgctgcctgaagccctaaggatcagcacactcagcctgctgttgtccaaggactggcctctacctggtgtcctcatccccagcaaagttctactaca

SEQ ID NO: 332825 - DNA, 284 bp, Homo sapiens
atcctaggatattctgcaactgtagatgcaactgctatgtctcagtttctacccaccactaaacagtgtaaaatgactgacctctccgtatggaaaactggaaacctaatatactactaagcatttttgaaagtattaaaaaagcaaccatgaccgggggcacactggctcactctcgtaatcccagcactttgggagatcaaggcaggagggtcacttgaggtcagcagttcaagaccagccaacatggtgaaaccctgtctctacaaaaaatacaaaaatta

SEQ ID NO: 332826 - DNA, 5702 bp, Homo sapiens
  misc_feature (6)..(6): n is a, c, g, or t
ggcggnggcgctcagcgcaggcaggtccccctgctgccgggtcccatttgttgccggctctgactcggggcggccgcggcgcgcggagctccggggagtcaggcggagcagccgcgcagccacgacggagcagcagcgggactggccgccccgcgcccccttcgccgccgtgcccttccccggcgcgctcaccccgttctcgggatgggattgtagcggcggcgcggactcggcggggatcgcggcggaggcggcggcgtcggcggcggcgtcggcggccgagcggggctccatgttttcccctggccaggaggaacactgcgcccccaataaggagccagtgaaatacggggagctggtggtgctcgggtacaatggtgctttacccaatggagatagaggacggaggaaaagtagatttgccctctacaagcggcccaaggcaaatggtgtcaaacccagcaccgtccatgtgatatccacgccccaggcatccaaggctatcagctgcaaaggtcaacacagtatatcctacactttgtcaaggaatcagactgtggtggtggagtacacacatgataaggatacggatatgtttcaggtgggcagatcaacagaaagccctatcgacttcgttgtcacagacacgatttctggcagccagaacacggacgaagcccagatcacacagagcaccatatccaggttcgcctgcaggatcgtgtgcgacaggaatgaaccttacacagcacggatattcgccgccggatttgactcttccaaaaacatatttcttggagaaaaggcagcaaagtggaaaaaccccgacggccacatggatgggctcactactaatggcgtcctggtgatgcatccacgagggggcttcaccgaggagtcccagcccggggtctggcgcgagatctctgtctgtggagatgtgtacaccttgcgagaaaccaggtcggcccagcaacgaggaaagctggtggaaagtgagaccaacgtcctgcaggacggctccctcattgacctgtgtggggccactctcctctggagaacagcagatgggctttttcatactccaactcagaagcacatagaagccctccggcaggagattaacgccgcccggcctcagtgtcctgtggggctcaacaccctggccttccccagcatcaacaggaaagaggtggtggaggagaagcagccctgggcatatctcagttgtggccacgtgcacgggtaccacaactggggccatcggagtgacacggaggccaacgagagggagtgtcccatgtgcaggactgtgggcccctatgtgcctctctggcttggctgtgaggcaggattttatgtagacgcaggaccgccaactcatgctttcactccctgtggacacgtgtgctcggagaagtctgcaaaatactggtctcagatcccgttgcctcatggaactcatgcatttcacgctgcttgccctttctgtgctacacagctggttggggagcaaaactgcatcaaattaattttccaaggtccaattgactgacgcccttgacagccatctacgactttattaacaggttactgtgaagattttgccactaactctagattttacctttttgtaatgctgtttatcagaggagggtgacaggggctggaaataaagagaggggacatggtgatgaaacatggcaggagtgtaacagataccagtggtgtgttgcatgctcaaaacagcagcgtcgtcattgaagtctgcttgattaaaccataatatctttgtaataattggatttaaaatgctatgcttctatttttaaccttgggtttttaaccaagtttttttttttttttgtaatcttggacaagactttaaatcatattttacagatgtagaagaaatttattcaaaagtgtgggctcatgaagttcacttcagtgcagtgtggtgtaggtgttacgcgaagggcgcacagtgtctagaaatacttgatcgtggctcaaacctgaccagacagcagaggggcggctctgtacagtgtgactggtggacagatggccttaggcacaggtggttttgaaatctggggctttttctgatttatttttctgacttgttgggggagagaatattcataacttgtgggctttttttttttttaacttcagtggaatttactttagatattcattcatcaaatacatgggacttcacaaacaattttccataactttttagcctgtcttttgttatttctgcctaatatgatttgccccgatactcatcttgcacggccagaactgtttggttgattaaaatacatcagctcttaaaaactcattaactgagggtaattacagtagtagacatggtctgggtactatactaccatgtttatttgctgactgaattaagatttaagaatgattaaaaataagcttttactttttaaaaccacttgaggtttcataaagcttggggtttttttttttcctttgttaagaaagccaaccaatcacaatgatatagtcattgttgtgcactcccttttcaccatctgtcaccttcccttgcagcttaaggagcccagtaagttttgaaaatgtttgcgaatcaaactaaatttaagtgggatgattagatatacacaacaccaagtggtacatctgcagagataattcaaaattcctgcttttgagagagcaaatgagtgtttgctgaggaataattaaatgagaatttcataggagctccaccattcctgttactttcatttcattttgattaataattcttggatgcttggcatcgatcgtatcactgctcctagaaggtaaagatcctttaggacatgagactggtagaagctggctgagataaaataagtatttatttaaactaatgttctcttaatttgaccattgcagatttgggtgacttttttttaacctttgtacatatacgtaatttatatgattctaatgtactatatccatacttgaattggttttttcgtattttgcctactggcaaatattttgcctattttcagtcgttctaacctatttgaatacgcttttccttaaagtgatacgataatattactcttgattgctgctgcttaatttgatgtaatatgtttaaagttcagcctctcagttttaatatagctttatttttcagtggagatcattgtttaggatgagacatttttggttttggttttgtttgggtaaattttaaatggtgtgaaaatcgatgacaacagtcctcttacagatagcttgctgtattctgtatagcttactctacctgcagacagaaaatgaaagaaaaaaatggacttgcctagaataatatattgaatgccttttgatttagccagagtctctgatgattagctttcgctgatagagtatgtcttttcagcctgtaattctttgggccccaaagaatgacaaaggaggcactcgttctcttttcttgctgtatgcctagaaagtggttgaaggattcttgatgccctaaaaccatcttgtaagctaaatggtcttgcatccagaaaggccagattttacctaccaagaaaaaaagatatttttccagagagttaggtatatcataattttccatttcaagtcctgtttataagtctagtcattctgcaacgtgacatatcccccaaaatgaagttaccttccaagttggacacgtcccgtagttgggcatatgtctaactaaaagtttctgacttttagtaaattcagcttaaatataagttgaaatttgggaaataatttccaagctcttggaaggggtaacagtgaaccgccctccatgggctccacatcttttcctttggcttccaaagtcaggtcccgcccaccctgcctaaggaactgcagagaggtggcaaatcagcaaaaaggacaccaggctcttcttggccacttgtaggaagatccctttacaattttgactaaggagattttttttttcacagttgagttagtttgtgaaaataaagaactctgtagctcaccaaggtggagaaacgcaattcagaaaagtaatttctccaaggtcacttctttttttatgtcttgccatcactttaaaggactagccccactcccccatgtgtatacacaaggaaattgcagaccaattagttgtcttggcctgactctaatgccttttgcaagtagctttccagaagtaaaagtcccagtgatgtattcccatagaaatatttttcagttgtttatgtcgtttactacaaaaaaaaagattcagagtggatggagtacaactctgagtatttttctagtccggaattttttattaataatcggtgctgccgggtcatgcatgctgcaactctcaacatttcccttatttggttcagcttttagcaaaaagggctacagttcaccctgcagagtattaaggtttctggatttttttctcccaactgtggcccaaaagaattaaaatctgttaatataaatagagaacatatttatcattcctcgatagttaattatagactttggtacctttgtgcctcagggaagccacgtgatataactggttatagaatttcagggttagggtttaaagaaaggagaaagccattggaaaaatgatgggctccattaaggagactaatgaatctggatgcagaaatatgtcagaaactggcataaacatgattgtagtagaatttattttccagtaccaatagggaaattattttaagttattacatttactgtattgggaaacttgaggagaactctttagttcataaagcttcaatgtctttttttttttttttcatggaaaaactcaaacctctgttatttgggagctcagtattgtgtggacacttacgagagttttctgcttaattgaagtgtaatataggttgtagaattgttacctgcagttctatggttttgtttcacttcttttcttttttaaagccattctgttctttggatgtgcttgaaagggtgtgtgattacaccattgttaatgctgggtaaaaactatcttcttgcagccttgcctcataacagtggaatttctgatagacaaaccacaggactttgattttaagccaaatccatctccatccctttactgtcaatcttctgtcccagtagtttagcctttgtggcttaggttatgatgcgcctccttctgtgcgaccaatgagacgacttcagcatctttttaaaataatctaagcatcattgaagcagtaacacaaaaaaaaggttcagtattttctttttagtataacttacatcctttcaaataagtctttgccctcatgaagaatccctagaggaagataaggaaaataagtattttccagttttgcttgacagtttctaaacaaacaaaaataaactcaatgaaaggaaagatgtttctttttagctgagatgacagattgcttctctgtattaaatagtctagaagttaaggggatggtcacatttaccatgtattgtgttattagcagttaaattttatgaatatgtttgtaaaattgttgttttatatttcatgtcaaattgaaaagtttatttcttcactattgtacctgtggaaatacaagccattttacaggaaaaaatcttcaaaaactattaaatggatatcagcctgtttgtga

SEQ ID NO: 332827 - DNA, 5917 bp, Homo sapiens
  misc_feature (6)..(6): n is a, c, g, or t
ggcggnggcgctcagcgcaggcaggtccccctgctgccgggtcccatttgttgccggctctgactcggggcggccgcggcgcgcggagctccggggagtcaggcggagcagccgcgcagccacgacggagcagcagcgggactggccgccccgcgcccccttcgccgccgtgcccttccccggcgcgctcaccccgttctcgggatgggattgtagcggcggcgcggactcggcggggatcgcggcggaggcggcggcgtcggcggcggcgtcggcggccgagcggggctccatgttttcccctggccaggaggaacactgcgcccccaataaggagccagtgaaatacggggagctggtggtgctcgggtacaatggtgctttacccaatggagatagaggacggaggaaaagtagatttgccctctacaagcggcccaaggcaaatggtgtcaaacccagcaccgtccatgtgatatccacgccccaggcatccaaggctatcagctgcaaaggtcaacacagtatatcctacactttgtcaaggaatcagactgtggtggtggagtacacacatgataaggatacggatatgtttcaggtgggcagatcaacagaaagccctatcgacttcgttgtcacagacacgatttctggcagccagaacacggacgaagcccagatcacacagagcaccatatccaggttcgcctgcaggatcgtgtgcgacaggaatgaaccttacacagcacggatattcgccgccggatttgactcttccaaaaacatatttcttggagaaaaggcagcaaagtggaaaaaccccgacggccacatggatgggctcactactaatggcgtcctggtgatgcatccacgagggggcttcaccgaggagtcccagcccggggtctggcgcgagatctctgtctgtggagatgtgtacaccttgcgagaaaccaggtcggcccagcaacgaggaaagctggtggaaagtgagaccaacgtcctgcaggacggctccctcattgacctgtgtggggccactctcctctggagaacagcagatgggctttttcatactccaactcagaagcacatagaagccctccggcaggagattaacgccgcccggcctcagtgtcctgtggggctcaacaccctggccttccccagcatcaacaggaaagaggtggtggaggagaagcagccctgggcatatctcagttgtggccacgtgcacgggtaccacaactggggccatcggagtgacacggaggccaacgagagggagtgtcccatgtgcaggactgtgggcccctatgtgcctctctggcttggctgtgaggcaggattttatgtagacgcaggaccgccaactcatgctttcactccctgtggacacgtgtgctcggagaagtctgcaaaatactggtctcagatcccgttgcctcatggaactcatgcatttcacgctgcttgccctttctgtgctacacagctggttggggagcaaaactgcatcaaattaattttccaaggtccaattgactgacgcccttgacagccatctacgactttattaacaggttactgtgaagattttgccactaactctagattttacctttttgtaatgctgtttatcagaggagggtgacaggggctggaaataaagagaggggacatggtgatgaaacatggcaggagtgtaacagataccagtggtgtgttgcatgctcaaaacagcagcgtcgtcattgaagtctgcttgattaaaccataatatctttgtaataattggatttaaaatgctatgcttctatttttaaccttgggtttttaaccaagtttttttttttttttgtaatcttggacaagactttaaatcatattttacagatgtagaagaaatttattcaaaagtgtgggctcatgaagttcacttcagtgcagtgtggtgtaggtgttacgcgaagggcgcacagtgtctagaaatacttgatcgtggctcaaacctgaccagacagcagaggggcggctctgtacagtgtgactggtggacagatggccttaggcacaggtggttttgaaatctggggctttttctgatttatttttctgacttgttgggggagagaatattcataacttgtgggctttttttttttttaacttcagtggaatttactttagatattcattcatcaaatacatgggacttcacaaacaattttccataactttttagcctgtcttttgttatttctgcctaatatgatttgccccgatactcatcttgcacggccagaactgtttggttgattaaaatacatcagctcttaaaaactcattaactgagggtaattacagtagtagacatggtctgggtactatactaccatgtttatttgctgactgaattaagatttaagaatgattaaaaataagcttttactttttaaaaccacttgaggtttcataaagcttggggtttttttttttcctttgttaagaaagccaaccaatcacaatgatatagtcattgttgtgcactcccttttcaccatctgtcaccttcccttgcagcttaaggagcccagtaagttttgaaaatgtttgcgaatcaaactaaatttaagtgggatgattagatatacacaacaccaagtggtacatctgcagagataattcaaaattcctgcttttgagagagcaaatgagtgtttgctgaggaataattaaatgagaatttcataggagctccaccattcctgttactttcatttcattttgattaataattcttggatgcttggcatcgatcgtatcactgctcctagaaggtaaagatcctttaggacatgagactggtagaagctggctgagataaaataagtatttatttaaactaatgttctcttaatttgaccattgcagatttgggtgacttttttttaacctttgtacatatacgtaatttatatgattctaatgtactatatccatacttgaattggttttttcgtattttgcctactggcaaatattttgcctattttcagtcgttctaacctatttgaatacgcttttccttaaagtgatacgataatattactcttgattgctgctgcttaatttgatgtaatatgtttaaagttcagcctctcagttttaatatagctttatttttcagtggagatcattgtttaggatgagacatttttggttttggttttgtttgggtaaattttaaatggtgtgaaaatcgatgacaacagtcctcttacagatagcttgctgtattctgtatagcttactctacctgcagacagaaaatgaaagaaaaaaatggacttgcctagaataatatattgaatgccttttgatttagccagagtctctgatgattagctttcgctgatagagtatgtcttttcagcctgtaattctttgggccccaaagaatgacaaaggaggcactcgttctcttttcttgctgtatgcctagaaagtggttgaaggattcttgatgccctaaaaccatcttgtaagctaaatggtcttgcatccagaaaggccagattttacctaccaagaaaaaaagatatttttccagagagttaggtatatcataattttccatttcaagtcctgtttataagtctagtcattctgcaacgtgacatatcccccaaaatgaagttaccttccaagttggacacgtcccgtagttgggcatatgtctaactaaaagtttctgacttttagtaaattcagcttaaatataagttgaaatttgggaaataatttccaagctcttggaaggggtaacagtgaaccgccctccatgggctccacatcttttcctttggcttccaaagtcaggtcccgcccaccctgcctaaggaactgcagagaggtggcaaatcagcaaaaaggacaccaggctcttcttggccacttgtaggaagatccctttacaattttgactaaggagattttttttttcacagttgagttagtttgtgaaaataaagaactctgtagctcaccaaggtggagaaacgcaattcagaaaagtaatttctccaaggtcacttctttttttatgtcttgccatcactttaaaggactagccccactcccccatgtgtatacacaaggaaattgcagaccaattagttgtcttggcctgactctaatgccttttgcaagtagctttccagaagtaaaagtcccagtgatgtattcccatagaaatatttttcagttgtttatgtcgtttactacaaaaaaaaagattcagagtggatggagtacaactctgagtatttttctagtccggaattttttattaataatcggtgctgccgggtcatgcatgctgcaactctcaacatttcccttatttggttcagcttttagcaaaaagggctacagttcaccctgcagagtattaaggtttctggatttttttctcccaactgtggcccaaaagaattaaaatctgttaatataaatagagaacatatttatcattcctcgatagttaattatagactttggtacctttgtgcctcagggaagccacgtgatataactggttatagaatttcagggttagggtttaaagaaaggagaaagccattggaaaaatgatgggctccattaaggagactaatgaatctggatgcagaaatatgtcagaaactggcataaacatgattgtagtagaatttattttccagtaccaatagggaaattattttaagttattacatttactgtattgggaaacttgaggagaactctttagttcataaagcttcaatgtctttttttttttttttcatggaaaaactcaaacctctgttatttgggagctcagtattgtgtggacacttacgagagttttctgcttaattgaagtgtaatataggttgtagaattgttacctgcagttctatggttttgtttcacttcttttcttttttaaagccattctgttctttggatgtgcttgaaagggtgtgtgattacaccattgttaatgctgggtaaaaactatcttcttgcagccttgcctcataacagtggaatttctgatagacaaaccacaggactttgattttaagccaaatccatctccatccctttactgtcaatcttctgtcccagtagtttagcctttgtggcttaggttatgatgcgcctccttctgtgcgaccaatgagacgacttcagcatctttttaaaataatctaagcatcattgaagcagtaacacaaaaaaaaggttcagtattttctttttagtataacttacatcctttcaaataagtctttgccctcatgaagaatccctagaggaagataaggaaaataagtattttccagttttgcttgacagtttctaaacaaacaaaaataaactcaatgaaaggaaagatgtttctttttagctgagatgacagattgcttctctgtattaaatagtctagaagttaaggggatggtcacatttaccatgtattgtgttattagcagttaaattttatgaatatgtttgtaaaattgttgttttatatttcatgtcaaattgaaaagtttatttcttcactattgtacctgtggaaatacaagccattttacaggaaaaaatcttcaaaaactattaaatggatatcagcctgtttgtgagccattgtcttcagattctgtggttgtcactgagttcattaggacatttagtaggttgatacgagtagaactgatttttttcacttctctaacttccaagttaatctccagctgttgagtttattaattgttttatattctgcacaatacatatttaaaccttgattctgaaaatcccctacattttttaattaaagaaatttccttggtgccta

SEQ ID NO: 332828 - DNA, 1798 bp, Homo sapiens
  misc_feature (6)..(6): n is a, c, g, or t
ggcggnggcgctcagcgcaggcaggtccccctgctgccgggtcccatttgttgccggctctgactcggggcggccgcggcgcgcggagctccggggagtcaggcggagcagccgcgcagccacgacggagcagcagcgggactggccgccccgcgcccccttcgccgccgtgcccttccccggcgcgctcaccccgttctcgggatgggattgtagcggcggcgcggactcggcggggatcgcggcggaggcggcggcgtcggcggcggcgtcggcggccgagcggggctccatgttttcccctggccaggaggaacactgcgcccccaataaggagccagtgaaatacggggagctggtggtgctcgggtacaatggtgctttacccaatggagatagaggacggaggaaaagtagatttgccctctacaagcggcccaaggcaaatggtgtcaaacccagcaccgtccatgtgatatccacgccccaggcatccaaggctatcagctgcaaaggtcaacacagtatatcctacactttgtcaaggaatcagactgtggtggtggagtacacacatgataaggatacggatatgtttcaggtgggcagatcaacagaaagccctatcgacttcgttgtcacagacacgatttctggcagccagaacacggacgaagcccagatcacacagagcaccatatccaggttcgcctgcaggatcgtgtgcgacaggaatgaaccttacacagcacggatattcgccgccggatttgactcttccaaaaacatatttcttggagaaaaggcagcaaagtggaaaaaccccgacggccacatggatgggctcactactaatggcgtcctggtgatgcatccacgagggggcttcaccgaggagtcccagcccggggtctggcgcgagatctctgtctgtggagatgtgtacaccttgcgagaaaccaggtcggcccagcaacgaggaaagctggtggaaagtgagaccaacgtcctgcaggacggctccctcattgacctgtgtggggccactctcctctggagaacagcagatgggctttttcatactccaactcagaagcacatagaagccctccggcaggagattaacgccgcccggcctcagtgtcctgtggggctcaacaccctggccttccccagcatcaacaggaaagaggtggtggaggagaagcagccctgggcatatctcagttgtggccacgtgcacgggtaccacaactggggccatcggagtgacacggaggccaacgagagggagtgtcccatgtgcaggactgtgggcccctatgtgcctctctggcttggctgtgaggcaggattttatgtagacgcaggaccgccaactcatgctttcactccctgtggacacgtgtgctcggagaagtctgcaaaatactggtctcagatcccgttgcctcatggaactcatgcatttcacgctgcttgccctttctgtgctacacagctggttggggagcaaaactgcatcaaattaattttccaaggtccaattgactgacgcccttgacagccatctacgactttattaacaggttactgtgaagattttgccactaactctagattttacctttttgtaatgctgtttatcagaggagggtgacaggggctggaaataaagagaggggacatggtgatgaaacatggcaggagtgtaacagataccagtggtgtgttgcatgctcaaaacagcagcgtcgtcattgaagtctgcttgattaaaccataatatctttgtaat

SEQ ID NO: 332829 - DNA, 370 bp, Homo sapiens
tgagatggaatccgtgatttacttgtggggccacgtgggaaggagccagaatggaggcccagggctgggaggtgtccgtgctggagccagttttgagccaagcctcaggaagctggctgccttctgcagagctgctgggtgggagagccgtggagctggcagccgagggttgtcacatctgagcctgaagactactatagctgaagcatcattcactggacgtgacttctctcaaatagtgatccccttaaatgctttggtcttatctgtcgtgtagaatctgttctatctggttttgtgtttgtgttcaccaccacttggaagaactaactgagacttctgaagaatagacggtcacatggcctgggtt

SEQ ID NO: 332830 - DNA, 484 bp, Homo sapiens
cctggggagcttggcttagggaagttgtgggcctaccagggccgctgggagctgggcaggagctgagtccaaagacgttgttgggacctggagtcgggccagagtccggcctggagatgcagccgggaggaagagccgggcccggagggggcgccgggaggctgcaagtgggtctgagaggccaacttgaggaggcctggcctctgcctcccgcattgcccagctgttcctcctggctgcatctcccacctcccagcaaacaagctcttattggctcagctcccgcctgcgtttgtagaccccgaagtttctgcaaccaagctcttcagacccacatcccttctcccagtgactgaacagtcccagctccggctggagaagggcgtctgcagaccccgctgttgcctcccaggggagtctccaggcccagctctcgccccaccgcgacctcccaggcccaagtccctgccaagccccagctgcg

SEQ ID NO: 332831 - DNA, 2477 bp, Homo sapiens
cacctttccgcgggccgcggggatggcggcgcagggcgtagggcctgggccggggtcggcggcgcccccggggctggaggcggcccggcagaagctggcgctgcggcggaagaaggtgctgagcaccgaaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcaaagggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332832 - DNA, 535 bp, Homo sapiens
agctcggccccttatttttttctctctttaacattcctgataagacagtacaatttactggtccaccattatccgtaacacttaaatcgacagagaacatcactctgcgtcgcagaagtgtcgtctgcacagacatttaactgaccctgaccattctggcgctctcagaacactccgccgggaatcctctatagcatacttggactcctgcaagctgggggcgtgcggttgttgtccaacgtcattcctgggatatcccatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332833 - DNA, 2269 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332834 - DNA, 1913 bp, Homo sapiens
ggacgcgtgggtcgaccacgcgtcggggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332835 - DNA, 2539 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaaaaaaaaaaaaaaaaaaaaaaaaaaaaaaaaaagggggcgcgcgcgcgcctctctataagatttctctccctctgggggggcgcgcccacgcttctctgcgcgctctctccccccagccttttttctgtgtgtccaaaggggtggcgctcctctatattgtggggagcgtctcctctttattatctccgcgcgataggcgcctcggcgcccccgtctctttttccaacaccgtctgccgtagcgtgtgggaacacacccgtgtgctccccg

SEQ ID NO: 332836 - DNA, 2262 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttggaaaaaaggggccttgtacttttcttaaaaaagcatttggcccttttggtcaaccaataccgttttattaagagccttccccc

SEQ ID NO: 332837 - DNA, 2240 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332838 - DNA, 2248 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332839 - DNA, 1898 bp, Homo sapiens
cgccccggaaatacgaacaaaactaacggctaggtacgaggctgggtggttgcgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332840 - DNA, 2239 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctggtcccccaaaggaccatccaggtgataacacagggaacatccctgaagaatgctggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332841 - DNA, 1329 bp, Homo sapiens
  misc_feature (1285)..(1285): n is a, c, g, or t
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaaagcngcagggacgggcctggtggcccggattggttgttgccctggtga

SEQ ID NO: 332842 - DNA, 1807 bp, Homo sapiens
cgccccggaaatacgaacaaaactaacggctaggtacgaggctgggtggttgtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332843 - DNA, 1969 bp, Homo sapiens
cttctacaaaactcagagggactcttcaggagccacatgctctcatcaagcagaaactttttaagaggtagacaacaacccagagtggacacagagctggtgctcttccagtagagtagagacggggtttcaccatgttggccaagctgatctcgaactcctgacctcaagtgatccaccctcctcggcctcccaaagtgctggaatcacaggcgtgagccaccgtgcccaaccagtgaggccacgtttcgaaaagaagaaagaaacgacaaactaaaatacatgactgtgtagatgaggaaggacatgaaatgaaacaggaaaaaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332844 - DNA, 1574 bp, Homo sapiens
ctgactgactctgttgtcaaaagcgcgttttatcgacgtgagcaacgatgacggtcgaaacagtagcgaggcttgagatgtggaatatctggcggatgtgccgataatgagatcatctgccgtttcgactaaaccagtgtgtcgcttgtcattaatgattcggcaggttaacctgcattaatgactcggcatggcacggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332845 - DNA, 1720 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332846 - DNA, 2350 bp, Homo sapiens
tttcttcgacgtattgcccgctacataggcgaccatggtgggacccacatgtggtggtgttctcaatgggcttatgtcaatgtcgtcgtcttgtgggtaatgtgccattctcatatttgaacctagtgctcatgcggttagccaatcgtgttgtctcactgggccctggtgctcttaccactatggtgaacggatcacagaatgtctcgccatactgatccccgtttcgtcccaatggggctcgtttgctctcccaattcgtagtggaccaccgccaaggtggataaggttctgtgcgtataaggacccaagcgaacctctagtcaaacctccggatgtgctattctcttccaaacaatggtacggactcctactttctactcgggtttatggtcaacactatcgtcctccaagggattccaggtatgcgcttcactcggagtgtcgcccgggaatactaactggcaaatgacacactcggtgtgctcaacgggcttcccctgtgacccgggacggatgggtgcaatcagcttttcgtctgggtgcgccgcctgggaaaatgactcaaggctcttcccactttggatcgctccccctatgccaggtgaccatggcgtttgtacgtgcgtctctcttttgggtccccttatttctctcctacctaatctctctctcggcgttttaccgggtggccttcctcatgacctcatgtgggccccatcctggacgccatccggaattgtgcttacttttgcgcccggtatacgcccttgtgcgctattcgcccccactgacttctgctccacattgtgtgaccttggttgcgtgacgttcgtggcgctgaccagttcgagggcacaaggcacgtcttctttgcatcccaagtcatgtcattctaagcggtgtccaatctcaaaaaggttccactaagtcccgccgatggtcctttcggacagctcgtcctatttcagcgaagtggctccgaccatagctgaaccggtcgtggcgcttctatgggacaggcttccctccagccacgtttcatgtccaggcgaatttggttcttcccagtgtctattgcacctctaggattgagtccccgtctttgtgggtgacactcaagctccacggactctgccatcatgtggtcctctcacgacgtcattgtgctccacgactccactcacaagggccattggtgctgtggacgatggcaacggtcacttgctaatgccacccatgggcaagttctctaacccccagtgagagatttcgaccttcaccatgtccacgaactgaacagcaatttcctccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332847 - DNA, 1509 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgatggcaaaaacctttggcccaggggcagaacgggaacgcgcgtatgtgacaccgtgcccgaggagggacaatgggagaaaggcagccggtcccggggccggtagacggcacaagtagcacgagagctcaacggcaacaggttttcgagcaaaaccccagacgaccaggtgccgtgtggtgaccaccgaatggagtcacgcgtccacaccctggcggtgctgccaacacgggagctaaacgacggctaggcgaagagacgacaatcgacagcgagagtagacgaccagacagcaggacaacacaagaagagaaaaaacaaaacaatcagtgtactagagtaagttagaccagtcagaagagacacgacaa

SEQ ID NO: 332848 - DNA, 850 bp, Homo sapiens
cctccctgcttttctttcctccctgttttcctccaagccttcgcctgtgcctggcagatctctttgccctccctttaaggagatcattggctgttccaggaagctgatgccgaagggcacacagcttggcccatttgccctctcccttctggtcctgaattactgagcacattatccaggctggagccctacatcctaccaatgggtgatttggccaagagaggagggtggacgtggtgcagccaggaggtgtaacagtcaccttgccttctccacacagtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332849 - DNA, 406 bp, Homo sapiens
  misc_feature (40)..(40): n is a, c, g, or t
  misc_feature (69)..(69): n is a, c, g, or t
  misc_feature (73)..(73): n is a, c, g, or t
cgcgcgctgctgcgctattgcgcgtagctcagacgctctnagcgcgctgcaatgctggcgctacgcatnattngcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332850 - DNA, 512 bp, Homo sapiens
gaatatccatggaagctgagcagatgccctgttgctctcccatctcagctctttgattctgagaccatcatccgctcattgcacctttgatcacaaaagctttgaacttctgattctgctcccaatccctcgctcctttttcccctatcccctgtgccaaccaggagtttcttctatttccaggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctaccccca

SEQ ID NO: 332851 - DNA, 779 bp, Homo sapiens
  misc_feature (779)..(779): n is a, c, g, or t
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcagggtaaggcgagagagagaaaattgaggtctctagggcaacctccatggaaaaaaggctgtcgcccaggccagcgcgcccccctcgcatgcaccccgtatcaattagttccggggcctcctaattggtctttctgcttcccctgtgccgaaan

SEQ ID NO: 332852 - DNA, 736 bp, Homo sapiens
cagtgacctcatggtagcttctctctgtccccaggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332853 - DNA, 1949 bp, Homo sapiens
ggacgcgtgggtcgaccacgcgtcgtgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332854 - DNA, 2694 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaaaaaaaaaaaaaaaaaaaaaaaaaaaaaaaaaagggggggggggcttaagatttcccccgggggggcccagttttgggttccccgggttttttgttgtccagaggggggcccccctaagaggcggccctcctcattttatcacgccagcggagcacctggcgcccggttgttttcaacgaggctgtcgcgccacctgggggcaaaacaatcggtctgtcaccgtgggcgactccttgtggtagcggagcgacacccccctcaccttccctgggggggggccgcgccccaatagtggggcgccccaactgcctccccctcgccgcggattctttccagggccctcctagtggctaacctccttccgactctcccaagggctgctactcagcggggcgtgttacaaccaccgccgccattataccccg

SEQ ID NO: 332855 - DNA, 2277 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttggtcacatctgggtgaagcggctttgacattgttaactggatttgactgtgtaaggaatacgctaataaagctacccaaaaaaaaaaacacccaacaca

SEQ ID NO: 332856 - DNA, 2290 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaattcaccttgccttctccacacagtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332857 - DNA, 3692 bp, Homo sapiens
aaaacacattaaaaactttattgtaagtatcaacatctaaatttgcatcaatttgatacatcgttgctcattttgcagaacataacagttgcacattgcaagagtcaacttgcttcgggtcttttcatgctcatggcggtccacccctgccttccctctccctgacctgcatcctgtcctccacagtctgccctgcctcctgtcgccacaggttgaagacccaagccctgaggagaacctgctgccagggggctggctggctgcgagccaggagggccaggcagttagccctgccacagggaggggcaggcaagggatcgtttctcctcttcctgggctgagcccgtgccaggccagccacagagtgccctagtcagcccatgtggctccaggaagcctgctgttgttctactccatcccatttcacccgcagcctagtggctaactccggatactctgagcaaaattaacccaagtttcatggagaactccagaaccttgaaccagtgcatggttatcaccattctttgttactagatgtaggagaaggtactgcagagtcctctggcctggaacagcttgggggaggattcagctccctgtttctccctcactcccaggagattcgaaaacaagtttgagagaaaaaacagtaactaaaaaagtccatgaagaaggatctgacatgtcctttgtgaagtaacattaccctctccccatcacgacgcaggagatgacatgttacagtaagagggttacagcaattccccatctggagtgccattcaactgcctgcagaaatcttccattttaatgcattttaaacacattcaaaacgagtgctgactctccaacctagggaaaatgcccaataaaaaatatagatagaaaatacatgctaatgtaatggcaaacttatctccacactaaaacggcaacagtcttgcggttgagggcaggggtgcggtggaacctccctcttcccacaagaacatcagcaccagagatgctcggtccccgggctgatctgatggtggggaccacgcactgtcactcggctgccggtccggtcccagtgttggcctgggactatcagtgctgcagcaggaagttggtggcgacattgaggtcattgtttgaagctctcagggcttccaaagcatcacctctggaaaatcccatctccatgagccgggcgacctgttcctcagaaacttctagagggggcgctgctggctcagactgccgaccgccctgatagtttacgttttgtcgctgacgtaaaggaggaaaaagacgattccaattgatcattcctccctgctgctgtctctgtcgcctcccttgtgcaaactgagagaacatcagctgccggtccagcagctccattctctgctgtctctggatgtccagcgtggctcccatcccaattctggcttcgctggtgggttctgaagaagagaagatgggttcaagtgtccaagaaaagaattttgccatccagctggggatgcagagcacctgatgcacctggaacattttgctgtcgtagcacagaccggacataagtccacttatggctacaatccagatgtaggaaccagaggtgaaaagctgcagtcccaatatataaatcaatgtcttgtttgtgatggacaacggacccagaatttgtgccacttggactcttggtatggagcagtaaaatggtacaaacagagcaaacacaggtgccaggaatccagaaggcaaattactagctgcagtgatgccaaagaaatactgcatagcttcaatgaggagaaagtcaaataaggctgacaaaacccaggaacccagcaaaaagcgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332858 - DNA, 1890 bp, Homo sapiens
caacctagtatacacgctagtagccgcggttaatcggacgaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332859 - DNA, 1987 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggacgctgaacgcgggcctctgacactgcttacactgcactctgaccctgtagtacagcaataaccgtctaataaagagcctacccccaacaa

SEQ ID NO: 332860 - DNA, 2302 bp, Homo sapiens
  misc_feature (1623)..(1623): n is a, c, g, or t
  misc_feature (1628)..(1629): n is a, c, g, or t
  misc_feature (1642)..(1643): n is a, c, g, or t
  misc_feature (1647)..(1647): n is a, c, g, or t
  misc_feature (1658)..(1659): n is a, c, g, or t
  misc_feature (1661)..(1661): n is a, c, g, or t
  misc_feature (1665)..(1665): n is a, c, g, or t
  misc_feature (1668)..(1668): n is a, c, g, or t
  misc_feature (1677)..(1677): n is a, c, g, or t
  misc_feature (1680)..(1680): n is a, c, g, or t
  misc_feature (1695)..(1696): n is a, c, g, or t
  misc_feature (1703)..(1703): n is a, c, g, or t
  misc_feature (1736)..(1739): n is a, c, g, or t
  misc_feature (1744)..(1745): n is a, c, g, or t
  misc_feature (1752)..(1752): n is a, c, g, or t
  misc_feature (1756)..(1756): n is a, c, g, or t
  misc_feature (1766)..(1766): n is a, c, g, or t
  misc_feature (1776)..(1777): n is a, c, g, or t
  misc_feature (1779)..(1779): n is a, c, g, or t
  misc_feature (1789)..(1789): n is a, c, g, or t
  misc_feature (1794)..(1794): n is a, c, g, or t
  misc_feature (1801)..(1801): n is a, c, g, or t
  misc_feature (1812)..(1813): n is a, c, g, or t
  misc_feature (1828)..(1828): n is a, c, g, or t
  misc_feature (1830)..(1830): n is a, c, g, or t
  misc_feature (1835)..(1835): n is a, c, g, or t
  misc_feature (1841)..(1842): n is a, c, g, or t
  misc_feature (1845)..(1845): n is a, c, g, or t
  misc_feature (1852)..(1852): n is a, c, g, or t
  misc_feature (1860)..(1860): n is a, c, g, or t
  misc_feature (1864)..(1864): n is a, c, g, or t
  misc_feature (1868)..(1868): n is a, c, g, or t
  misc_feature (1906)..(1906): n is a, c, g, or t
  misc_feature (1954)..(1955): n is a, c, g, or t
  misc_feature (1957)..(1957): n is a, c, g, or t
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacaggacatcctgaagaatgttgggaactgcctaagcctctgttatttatttttgtccttnttatnnatgtttccatttnngtgnttttgtatttnntntacnttnttttgtttnttntagatgttgtctttnntgttacntcttccttatagctttttttcattaggggtttnnnnttttnngtatatncttnttttctgttngcttttgganntnttctcttttntctangttttgntcttttttttnngtattacttttgtantntaggngttttnnttnttttgtntttaggtnctanttantgtcctttctgtttgggatctttgtctcctttgtcttntttatttccgttattttagtatctttttgttctctttgttatattttnntntttccattattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332861 - DNA, 1767 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332862 - DNA, 1899 bp, Homo sapiens
ttctgggctgcggagcatctgagcgtcgtcgagtcggcacctggtcttctcgtgtttcctgacccctccttccttgtgcacggtggtggatctgccggctctccctgtcttgagctcgttcttgcgtttcgatgctccctacggttgaacctgcctagttacactcgtatgtctggcggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332863 - DNA, 2183 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332864 - DNA, 1926 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332865 - DNA, 949 bp, Homo sapiens
gataggtcagagctgctctagaggaacccttcgatgtgggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaacaa

SEQ ID NO: 332866 - DNA, 1326 bp, Homo sapiens
  misc_feature (1189)..(1189): n is a, c, g, or t
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggctgctgatgaaaactttggccgtgcaaagggggcggttgtgacggccctggggtcntggaaggcgccgggcgggcctgattggccctttccgggtcgctgggttgtcggaaaccccgggcggctgttgccgaatttctgtgccccgttggcccggggcaccgggggagtgttcgacgtgggagccccggggca

SEQ ID NO: 332867 - DNA, 1256 bp, Homo sapiens
tgatagtcgaattccttcaacgtctagcacagtgccttcaaatttacccactcaaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaggaggaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaaggcttccttctccgtggcaccactacacatcaatattcctggcaatattcttcatcatggagacttcggcagcgacttcaaccagatgaaaagccccacctcattcctgaatgattgaggtgctagaacatgctctttgtaaacccctgaaacatggcttggatcattccgtctcccacctcagcccctccggagctgcctggacctcatcattccggagagtctaagtggcctcttctcgtgctcagctgcttacct

SEQ ID NO: 332868 - DNA, 291 bp, Homo sapiens
ctggatgtctcaggagaaaaatacgagggctgcttcacccaccagtgttgacagcataaggtctcagtgatggctcctgggggagggatccaggacaccaacccactatcactgtggccctgtgagccagcactgtgggcctgtttgatgttaagaaaccagagagaggaggggatagccgggcacagtggctcacgcctgtaatcccagcactttcggaggccgaggtgggtggatcacttgaggtcaggagtttgagaccatcctggccaacatggcaaaaccccgtct

SEQ ID NO: 332869 - DNA, 246 bp, Homo sapiens
tgaggagagtttgccagaagttcatctccagtttagtcatctctggacccaaccactgggctgagcttctttctggaacttcttgaaacaacaagaactcaaggcgcaacagttacaaaagtgagttttctttttctttttcttttcagacggagtcttgctctgtcgccaggctggagtgcagtgacgccatcttggctcaccgcaacccctgtcccctgggttcaagcgattgtcctgcctcag

SEQ ID NO: 332870 - DNA, 474 bp, Homo sapiens
cctaattcatctggcatcactggggccaaaagctacaaagtccattttgagctctaactttgcagagtcatttccatcctcctgccttccccatcctgacaagtgcacatgcacacacacattgccagacacccagcagacacagaatcaatgcttttgcgtgagtgaaacagcccctctggcagccctcttcacctgcccagtccccagtgcccagcacccagtgctgagctggtgaagatcccgtggccagaggcacacttaccatatacatcatgactcagatcccatttgctgacttggaactgaagcctcttgccccaccaagcaattactggagaacaggaagtctcaacggaaaatgaggtcagcctggtggctgagaggaaaagggtcagcgagcacagccttctgcccccgtgggtccccacagcggccagcccagggccctgcatgcagcagatgcccaccaca

SEQ ID NO: 332871 - DNA, 510 bp, Homo sapiens
aataggcatttattctcacagttctggagactgggaagtccaagatcaaggcactggcaggcttggtgtctgtgaaggccttttttccacttccaagatggtgccttattgctgcatcctctggaggggaggaatgctgtgtcctcattaggcagaagggcagaggaggcaataagggacaaactccctctatcgagcccttttttgaaagtatttaatcccattcatgaaggaagactcctcatgactcaatcacctcctaaaggccacacctcttaatactgttggattggggattaagttcctgcacgaattttggaggggacaaaaaccattcaaaccatatcagaggccaatgttgtagcctggatgagagattgaagtggcttggattaagatgacagtaagtgaatatcatagtaaatgtagacaaaaaggtagagatttgaagtatattttggaggtagacttgaaaagacttgatagattcaatatatggaggctgagggt

SEQ ID NO: 332872 - DNA, 345 bp, Homo sapiens
gccccaagattcacatgaattaggagctacacaaaggaagtaggcccaggaataaccacacctaccacggatctcccgaggcagccgagcaaatgatgaggaaccacccctgggcatcctgaaggacaaccccaagggctcaaagcagcatctcatccacagcactcccctaaccccaccaatctgtggacccagtggatggttagtgggaactctggcgaggccaacgcaaggaatgggagcatcacaccagaccatccagtgaggtgaggaccttgactgggaattcctctcatctatgcttggcagagtggcccaagctcccaatctgtcaggtgactggaa

SEQ ID NO: 332873 - DNA, 462 bp, Homo sapiens
ttatgtggccacatctttcttagtttttttattacctgtaatctggctataataatgctaaatattgaagtataagtatatttattacagtaacagctattgtgtgttgactgcttgctatggacaaagcagtaagacagcactttccatacattatcttttagaatcttcttgctaatccctgaaaataataattaaagtgcagaaagtccaataaattacccaaggtcatgtttctactgactgaaggagctgtggttgaaaactaggtttatcagacccccaaatcagtgcttagagcagctgtgctcactaccttcacacacagaaacacacacacatacacagacacacacacacagacacacacacacactaagcaaaactactgaacactctttgccatcattctgctgctatttagacttaaaacaaaaatctaattaagaacaagcaggagaa

SEQ ID NO: 332874 - DNA, 581 bp, Homo sapiens
agttctggagatgggttacacaccaatgtaaatgtacttaacagtactgaattgtacacttaaaaatggttaagatggtaaaaaaacaaaaacaaaacaaccaacacccaaaatctagagcaataatgttctagaaggattatgagcacattacagaaaaatgaggaaaagtctccatcaagcgggaaccactaccgagagcatgacttttctgccaagaaaggaggtcttttctggacctccaacccacagttcactgtggttcctagtcattttgtttttgccagtggcctatcttttgcttctgttccctctctcccagaacctaaaatattatgaatttgccgattgtttttaggaggtgcttaataattatttgtagatggctgattaatggaagggacagtggttaaatacgtagctgtggagactcagatctaatacaggtctgggtttcacaatttacttgctcaccacaagctacatgacttctctgagcctcatttttctcatacctaaattaaagagagaatagtaactacttcctagagttactgtgagagttaaacaagctagttctt

SEQ ID NO: 332875 - DNA, 225 bp, Homo sapiens
gctggtctcgaacttctggactcaagtgattctcccacattggcctcccgaaatggtgggattataggcacgagccactgaacctggcatgtactactttttaagtgtttctgggttgtgagattatagatgaattttgttttattcttcacactcatatgttgtttactaggcttttaactatgtgtatatatatatattgcctttgtcatgagagacactttt

SEQ ID NO: 332876 - DNA, 411 bp, Homo sapiens
gtcccacactccaggccttgctccctgtcctgaacagaagtccatgagctcatacttccctgtacctgcccatggtgtgatggttacctccgtggggcagtaaccaagatgggagctgctgaggaactggtttgaagcctccagccttccctcctgcctccctaaccctctagaaaaacctgctggagctacacacaccgtgtggataactcctagcacccaccagtcccagaccttgggtttcaggctgctgttcctatcaggctcacttcaggccctgccccatgccccactcccagcctggcagaggctagggtgtcagtttcgtggagctccagcttcagtttcatgtccccgtcaccagcctcttcatgaccttgcccttcaatggattgacacccctcaggcctt

SEQ ID NO: 332877 - DNA, 898 bp, Homo sapiens
  misc_feature (831)..(831): n is a, c, g, or t
  misc_feature (855)..(855): n is a, c, g, or t
  misc_feature (867)..(867): n is a, c, g, or t
  misc_feature (898)..(898): n is a, c, g, or t
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaaactgatgggaantcctgaaaacctccttcccaaagnaaaagcattggncacaaggggaatgggggcctgggaaacaaan

SEQ ID NO: 332878 - DNA, 396 bp, Homo sapiens
ggccactccccctgccccagtgtcctacccctgagtggcagaagaaacctgccaccacacaagatctcctagctttcctatgtttagtcttttaaaatatatgtgaatcaggccggacgcagtgctcacgcctgtaatcccagcactttgggaggccgaggcgggtggatcactaggtcaagagttcgagaccagcctgaccaacatactgaaaccctgtctctactaaaaatacaaaaattagctgggtgtagtggcgcgcgtctgtaatcccagctacttgggaggctggggcaggagaatcacttgaacctgggaggcagaggttgcagtgagccgagatcgcaccactgcgttccagcttgggtgacggggcgagactccgtctccaaaaaa

SEQ ID NO: 332879 - DNA, 3487 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatacttaatgccgcatgatctctatccctcttcccaataggggctggctcttttgacagcctttggcgtctgtagaataaatgctgtggctcctgctggctgctgtgg

SEQ ID NO: 332880 - DNA, 3316 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatactta

SEQ ID NO: 332881 - DNA, 3003 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcactggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatactta

SEQ ID NO: 332882 - DNA, 3006 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgtgagtactgcagaggggcagagtagacaggtcatctaccttcatcctctgaggatgtaggtcttaggctggaccaactcttgtctgtctaaggttgaagtgaagtcctcagaaatgccgttgctaaatagcgttcccaagaatctcagcatcctagcatgctcattagatccctgtatctgaaggtaacatttcctgacgaaacattcccaggaggaaaagggggaaaacattgtattcacattaccacacagttgcttgctgttgtttgctgggctgaaactagcaagaaggcttgtgtgaatttgggattcagcaaggcctggagtgcttgttgagctcttgatgtgggcctagcccttcccattcctggtatctcacctaatttcctttgacagcttgggcggcatctggggaatgtagctccattgtctcagagcccccgagcaggccacgtggttgactcagctcagtttggcttgggatagccacttctgccaatttggattcctctgtatctctctgggcctttttgggaaggtcatggtggcctggaaagtttctgcttccaaatgaagccttgtgaaaagaattgtggttttttttgtttgtttttttgaatgagccgagatcgcaccactgcgttccagcttgggtgacggggcgagactccgtctccaaaaaa

SEQ ID NO: 332883 - DNA, 2118 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatactta

SEQ ID NO: 332884 - DNA, 1895 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagattctccagacctgagctttccgcgtcagcaagtaggaatcgtttttgctgcagagaataaaaggaccacgtgcaatactta

SEQ ID NO: 332885 - DNA, 1996 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagattctccagacctgagctttccgcgtcagcaagtaggaatcgtttttgctgcagagaataaaaggaccacgtgcaatacttaatgccgcatgatctctatccctcttcccaataggggctggctcttttgacagcctttggcgtctgtagaataaatgctgtggctcctgctggctgctgtgg

SEQ ID NO: 332886 - DNA, 1545 bp, Homo sapiens
ggtggaggggagagggagaggcatttgtcccaccccaccttgggagaaccagagctgttctagttaagtctgttcacatatgagatttggtccacagtttaacaaaatagttggaaattcccatactgatgcccttgactttgcacgtggcgtgtgattgaggaagctcatggcacgtgctaggccaagccaggttggaacccgagtcctgcctgcaggaccatgctttcctgcctcgtcgtaccgcacctccagggatctcttccagctcttttctgtcttcttggtctggcaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatactta

SEQ ID NO: 332887 - DNA, 904 bp, Homo sapiens
cctaggctagtacgaggctgggttgtgcaaggatgtgcagagggagatgctgacttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatactta

SEQ ID NO: 332888 - DNA, 1005 bp, Homo sapiens
cctaggctagtacgaggctgggttgtgcaaggatgtgcagagggagatgctgacttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatacttaatgccgcatgatctctatccctcttcccaataggggctggctcttttgacagcctttggcgtctgtagaataaatgctgtggctcctgctggctgctgtgg

SEQ ID NO: 332889 - DNA, 722 bp, Homo sapiens
gtggcaggccttctgagggctgcaaatgctcacactagtgagggtccctgctccagcaccgtggcctgagccaggtcctccccacaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatactta

SEQ ID NO: 332890 - DNA, 193 bp, Homo sapiens
tgcagcgggcccttggcgggggactctgagggaggagctggggacggcgaccctaggagaggtaggccgccctcggagagctctgcggtgctaggagagcggctgggcccgcagactggggggaaagctccgcagccgcagtgggccccaggatcaggccccgcgtggcctggagaagcccagtctgggctgg

SEQ ID NO: 332891 - DNA, 383 bp, Homo sapiens
gccatagggaagctgggaaatgtaacctttattctgcacagccatatttccaactaaaaattgtagcactcgggggagcagataacgaggagataactagcagtctattacagacctctccatgagcccctctgccctttccagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggtaggatgggcgacggctgaatgccccccctc

SEQ ID NO: 332892 - DNA, 406 bp, Homo sapiens
ctggttgatacctggctttgccactctgtcctgtcctggcagtggccatggccgccccctgtaccagccgtaaagtctgtctcggcctccagcagtatcacccagggcaaggagtgggtgatggctcctccatcctttctttccctgcattcctccctcaatcccatcttctgtgctgactcccccttcccttcctgtcttctagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggag

SEQ ID NO: 332893 - DNA, 3386 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatactta

SEQ ID NO: 332894 - DNA, 419 bp, Homo sapiens
tccacggttggctagtgtggtagacccagaaacttctggggacgtcagtcatagttactaatatttggaggcagtgggagatgctggccccaaggttgaggtatcagttagagcagaacaattggacctagagctggtttttcctttgggtttaggtgtaagtgaactattatcattggagtggagaactggagagaaagggttgtcactgtccagcactacacagcgccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagccaaccgtggacaagtggtaccgagct

SEQ ID NO: 332895 - DNA, 3049 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggcttcagtgcctgaccaggcttcaatgcctgaccaggcttcagtgcctgaccaggcttcagtgcctgaccaggcttcagtgcctgacc

SEQ ID NO: 332896 - DNA, 2885 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggcaacccaggggccagggtcccctcccctagggctcatcagctctctggtggctgacatgtggcctctgtggctctgagcgaagtggttgcctaagggcccacggtctgggattgagattgggaggagcagcag

SEQ ID NO: 332897 - DNA, 2533 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggtaggatgggcgacggctgaatgccccccctccccacaccgtcactgtctgtccacagtcttagcagtgcggtgctctcactctgttgtatcagattcgtcctgcacgtagatttgcttaaagcaggctgggcacggtagctcacgcctgtaatcccagcactttgggaggccgaggcgggcggatcacgaggtcaggagattgagaccatcctggctaaccctgtctctactaaaaatagaaaaaattagccgggcgtggtggcgggcacctgtagtcccagctactcaggaggctgaggcaggagaatggtgtgaacccgggaggtggagcttgcagtgagccgagattgcgccattgcactctagcctgggaaacagagcgagactccgtctca

SEQ ID NO: 332898 - DNA, 1759 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagattttcctgtcccggatgcgacgccctctgtctgagagtcttgagaaactgcacctcttcttcactaatgatgtcc

SEQ ID NO: 332899 - DNA, 1307 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatacttaatgccgcatgatctctatccctcttcccaataggggctggctcttttgacagcctttggcgtctgtagaataaatgctgtggctcctgctggctgctgtgg

SEQ ID NO: 332900 - DNA, 909 bp, Homo sapiens
cgttatagcaccgtggtaacagccattctcatccaaaccccctgaagcttcacccgttatagcaccggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatactta

SEQ ID NO: 332901 - DNA, 500 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggtaagttcagagcagaagaacca

SEQ ID NO: 332902 - DNA, 284 bp, Homo sapiens
aagagatgaaatgactgctccaaggtgacacaaaaaaggcacagtccattcaactagacctccccaggatcttggaaccatgttttttccttcttcccttaccatattcattcaatacattactgcatgcctacctgggccagaaacttctcagacgctacacatgcagaagggaatgaaatgaaagacaaatggatgctgcacccattgttaagctgtaacattgtaaaggaagagggtagtgagaaagacacaagtacgccatcaatgtgggtttgaggcag

SEQ ID NO: 332903 - DNA, 610 bp, Homo sapiens
aaaggtgactaactagacgtctatctatctatctatctatctatctatctatctatctatctatgtctatctgtcatgtatctatactcgattataatttgtaggattttatttgtactcagtttttaaaatttcatgttttaattgaataattgttccactgggcttggggtagggtaggcattctttttgttgtttattgctgcttccagaccagagtccctccctgcttcccaaaagctcccacatgtgaatatcgtgtcattcagactctgccacctattagctttcttggttctactcatcttctgtcccctgggtttcacttctcctggctcactctcactctccccatataatcactcctgtcctaattcttggtgatttcagtattacaaagatgatcctcccaacaccttgacacctccctcagtaatcttgttctccactctcagtaaatgaaattatttttagcttagacaagagtgatagcagtaaaagtggtatgaaacaagcatatttgggatataatttgaagacaaagctgaaagatttgatgagggattggaatgtggaggaattctagaaggggcaatgtggcttgaggatt

SEQ ID NO: 332904 - DNA, 950 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatc

SEQ ID NO: 332905 - DNA, 3317 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatacta

SEQ ID NO: 332906 - DNA, 3606 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgctttaccctctgcatctattacatccaccagtgcagctgcagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatacta

SEQ ID NO: 332907 - DNA, 307 bp, Homo sapiens
  misc_feature (23)..(23): n is a, c, g, or t
  misc_feature (36)..(36): n is a, c, g, or t
gcctactactactactaaattcncggcccgtcgacnagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatacta

SEQ ID NO: 332908 - DNA, 519 bp, Homo sapiens
tgtgagtttacttagtcctgtgctttagataccatctatgaatagatgacgccaatatatgtttctctgactatgacctctctgggtaattcctggcgcctgtcaataactgcttacttgatgtccccatatgaatgtcagactggcatttcaaacttaatgtgtccctccctcattttgattttcacccccaaacctgcagccctccagcccactcatacttgctgttccctacctagcctcagctctcttttcccccttaggttgaatacaaagacttccccaaaaacaacaagaacgaatttgtatctcttatcaattgctcctctcagccacctctgatcagccatggtatcggcaaggatgtggagtcctgccatgatatggtacgtcacaccttgggtgagggattggggtgttgtgtgtttatgtggagcctgccttggttcagcttgttactagcctgaggaagatgggagaaagattgtcccatagaccttgagagcaatgaatcgtttg

SEQ ID NO: 332909 - DNA, 429 bp, Homo sapiens
catagaacgaatttagcattgttttctattgtgagatagggttacgaatcaagcttcgttgaccactagcagcttgtgaacattcagataaaaaaggagttttctaagagtgttcaagattttctggtcttttgtcagggcaatgcaaaatacactatgtgggttaatactgcttcctgcttttaacactttccctctagaagctgaaagcacattgctgtaccatatctctgaggtagtaattagtagacaagttaacctactttgaggatgaggaaatggaagcataaggaaattattgaagttgtacaaagctcagtgaatggttttaaactcaccacactggatttgtataatgcttttcttttctttctttctgaaacggagtttcgcttctagcctgggcaacacagcgagactccatctcaa

SEQ ID NO: 332910 - DNA, 3723 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaaaaaaacaaacggcggcgcctagaagtctcctagggcccgacgatcacgaccccgcttctgtacaggtccctatgaggcgatatacacaagcccgccttacacccacggaaccagctacatatgagaaacacctgggacaatggacacccgaatgcccgcaatacagaattggacagttcggaagtgtatattcgacaagccgtaacccactagtcacgagc

SEQ ID NO: 332911 - DNA, 3505 bp, Homo sapiens
  misc_feature (3454)..(3454): n is a, c, g, or t
  misc_feature (3469)..(3469): n is a, c, g, or t
  misc_feature (3479)..(3479): n is a, c, g, or t
  misc_feature (3489)..(3489): n is a, c, g, or t
  misc_feature (3499)..(3500): n is a, c, g, or t
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaaaggcctggaagnatccttggaaaaaanactttaaaanccaaacccanttgggccaannaacca

SEQ ID NO: 332912 - DNA, 2335 bp, Homo sapiens
ctggtctgtgttttgacttctttgtgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332913 - DNA, 3449 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaatacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332914 - DNA, 3320 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcgttgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332915 - DNA, 1641 bp, Homo sapiens
tgtttgccaatttcttttcatttttaacagtactttaattctcttacatttcaaaactagtgtcattttcatttttcttccttaaaggtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332916 - DNA, 2529 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaagccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332917 - DNA, 2433 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagttgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaattgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332918 - DNA, 1801 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaaatacaaagacttcccaaaaaacaacaagaaggctaaatccaaaaaaagaaaaaaca

SEQ ID NO: 332919 - DNA, 1640 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaaggaaggtgagtgctgtgggctctctgattgcaagatggtctctcgcctcaccctagggaactggggcacctccaggggcaggcttcaaggcaaggctttatctgcctgacagttcaaggagtcctgctgaggagtgtctcatccatttggaccataatgtgctcagaggggcctcgcatgtccactggccccaggaggctctgggttagatcgttgattgtgtcagtatctttgtggtctggggacgctttgtggagggcagcttgctcctctctatttgtaggatgaggatgaaggg

SEQ ID NO: 332920 - DNA, 492 bp, Homo sapiens
  misc_feature (23)..(23): n is a, c, g, or t
  misc_feature (36)..(36): n is a, c, g, or t
gcctactactactactaaattcncggcccgtcgacnagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332921 - DNA, 751 bp, Homo sapiens
gtcttcagtttcagagaaaagacctaccctactaaattattattattttttattttccagagtttattaaccacttaacctctcagaactgaacaaagacaacattgttcctggaacgccctctttttaaaaaaggtacatataatttggctttataatttctggcctgttgataatcagtggtacttttgaattctttaatgagttgtgtggagaatgatttttacttctggctataatattagagaaacaaattttatgcagtttgaatttcatctttactcttgatttaattagaaagtaagtacaggaaaagttattggcaagaatgtaaagcctatgttctttaaatatagagacatgagaattgatgactgaagctgtcattaaacatgactggctcaataagcttcttggtcatagtatcttttgtagtttgctttttttaaaaaaaccctttgatttctcagattgtttatgttaaacatgattttcaaactcatagaacgaatttagcattgttttctattgtgagatagggttacgaatcaagcttcgttgaccactagcagcttgtgaacattcagataaaaaaggagttttctaagagtgttcaagattttctggtcttttgtcagggcaatgcaaaatacactatgtgggttaatactgcttcctgcttttaacactttccctctagaagctgaaagcacattgctgtaccatatctctgaggtagtaattagtagac

SEQ ID NO: 332922 - DNA, 1025 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatc

SEQ ID NO: 332923 - DNA, 3440 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtggagttttgctcttgtcgcccaggctggagtgcagtggcgtgatctcggctcactgcaacctccacctcccaggttcaagcgattttcccacttcagcctcccgataagctgagattacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatacta

SEQ ID NO: 332924 - DNA, 3242 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatacta

SEQ ID NO: 332925 - DNA, 1166 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtggagttttgctcttgtcgcccaggctggagtgcagtggcgtgatctcggctcactgcaacctccacctcccaggttcaagcgattttcccacttcagcctcccgataagctgagattacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatc

SEQ ID NO: 332926 - DNA, 3502 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332927 - DNA, 3643 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtggagttttgctcttgtcgcccaggctggagtgcagtggcgtgatctcggctcactgcaacctccacctcccaggttcaagcgattttcccacttcagcctcccgataagctgagattacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332928 - DNA, 2617 bp, Homo sapiens
gggctgcaggattcggcacgaggttttatattgataattgttgtgatgaaattgatggcccctaagatagaggagacacctgctaggtgtaaggagaagatggttaggtctacggaggctccagggtgggagtagttccctgctaagggagggtagactgttcaacctgttcctgctccggcctccactatagcagatgcgagcaggagtaggagagagggaggtaagagtcagaagcttatgttgattatgcggggaaacgccatatcgggggcaccgattattaggggaactagtcagttgccaaagcctccgattatgatgggtattactatgaagaagattattacaaatgcatgggctgtgacgataacgttgtagatgtggtcgttacctagaaggttgcctggctggcccagctcggctcgaataaggaggcttagagctgtgcctaggactccagctcatgcgccgaataataggtatagtgatccaatgtctctgcggttcgcagagaatctcgtgccgaattcggtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332929 - DNA, 2851 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaa

SEQ ID NO: 332930 - DNA, 2152 bp, Homo sapiens
  misc_feature (1857)..(1857): n is a, c, g, or t
  misc_feature (1884)..(1884): n is a, c, g, or t
  misc_feature (1906)..(1906): n is a, c, g, or t
  misc_feature (1912)..(1912): n is a, c, g, or t
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagcctctgtcaccttcaatgcacattgctcagtgaaagaagcccatttgcnaaggctacatagcgtatgattccaacnatatgacattctgggaaaggcnaaaccntggagatggtaaaaggatcagtggttgctggggttgaagagagggatgaataggaagagcacagggtattttagggcagtggaagcactctgtatgatactgtgatggggacacatgtcttcttttttgtgttgagacagaatctcactctgttgcccaggctggagtgcagtggcgcgatcttggctcactgcaacctccgcctcccaggttcagtactctccattcagcctctggtac

SEQ ID NO: 332931 - DNA, 1469 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacccaaagacaccccccgaaaaaaaaaataaaaagaagaaaacataaaaataaaacacaaataaacacccaacataacaacaaaaaaaagggggggggcgcccaaaaaagttccccggggggggca

SEQ ID NO: 332932 - DNA, 790 bp, Homo sapiens
gccgcagtgccagccggaacttgtggttcggaccgtgggtgggggtggggccggggccgggcctggaggcgggcgggggccgggggcgggcgcctgcccctcccccgtcacttcctgccgggctgcgggcgcctgagcggctcttcagcgtttgcgccggcggctgccgcgtctctctcggctcccgcttcctttgaccgcctccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgctttaccctctgcatctattacatccaccagtgcagctgcagagtttattaaccacttaacctctcagaactgaacaaagacacattgttcctggaacgccctctttt

SEQ ID NO: 332933 - DNA, 7043 bp, Homo sapiens
ccccgaagttgttccgcgctgggcgggcgagcggctgtgggagagcgggcggcgggccggcgggcggaccgggccggtgctggagaagtttgcgctgcggttcgtgagcgcagggtgcgggccccgccggccgctgcgcgcccgctgccatggctttccgcaggaggacgaaaagttacccgctcttcagccaggagttcgtcatccacaaccatgcggacatcggcttctgcctggtgctctgcgtcctcatcgggcttatgttcgaggtcacagccaagactgcctttctatttattttacctcagtataacattagcgtgcctacagcagacagtgagaccgtgcactaccactatggccctaaggacctggtcacaatcttgttctacatcttcatcaccatcatcttgcatgctgtggttcaggagtacattttagataaaatcagcaaacggcttcatctctccaaagtcaaacacagcaagttcaatgaatctggacagctggtcgtctttcatttcacctcggtgatttggtgcttctacgtggtggtgacggaaggatacttaacaaacccaagaagcctctgggaagactacccgcatgtgcacctccccttccaggtgaagtttttctacctatgccagctggcctactggctgcacgcacttcctgagctatacttccagaaggtacggaaggaggaaattccccgccagctccagtatatttgcctgtacctggtgcatatagctggagcatacctcttaaacctgagccgcctgggcctgatcttgctgctgctgcagtactcaactgagttcctcttccacacggctagactcttctactttgcagatgaaaacaacgagaaactgttcagtgcctgggctgctgtttttggggttacccgcctcttcatcctcacccttgccgtgctggccattggctttggactggctcgcatggaaaaccaggcatttgatcccgagaaagggaacttcaacactttgttttgcaggctctgcgtgctgctgctggtgtgtgccgcccaggcctggctcatgtggcgcttcatccactcccagctgcggcactggcgggaatactggaatgagcagagtgcaaagcggagagtcccagccacacccagactaccagccaggctcatcaagagggaatctggttaccatgaaaatggagtggtgaaggcagagaacggaacctccccacggactaagaaactcaagtctccctaaggccaaagtgctaagaacaggaatcctcttggtgggggccgagcagggggcaaggagcccaggccccctccctgcctcctccttcctgcctgtgatgctccgtctcaaacagccgaaacctgtcttgcaatggggggagggggcgtttcgctttccttcttcttggcttcctcttattcttccacaaaccattctcaataaagccaaaaatctttctctttctccccctcaggccacctcctgtcctcactcctgtcctgtgctggcttttctggaacgccaggcgcccatggctggcacctttctgcttgctctgtttcttgccttatggctgctgcttttcctttttacttcctattttcaccttatcttgcaatttttctgtctgatttttacaatgggaggggagctaagattgcagtcctgtccttcggtcccccagggcctgccggtcagaagcctggggctggtaggcccttggtggtcctcatgtggatgggcaagaagagagcggccatctcggatcataatctccttggtgctgattaactgacgagatatatgattccagttctgcatgtaccatcttgaggcacagcagccactgctcgttgtaaatgccaaggcatttggctttgggacgtgacaactcaatccagaaggatggtgtgaactcggttgggtcccgtgactcgagctcctaccagtggctggccgcggattggaagccagcctgctgtcgctctgtggggggggacatgtcttcccactgcttagagcgagagcagagcaaactgcgcagcaggcacctccagaaaggtaatggtggcagaacccacagtggagtcgacctaggcctttctccagcagtcccagtcgccattgctttttcagccattcacaagcattcaaaaccaaaccaaacagcagttcatatacctgcctgagataggctggtcctcacctccagagccagccagccccgtcaggggccaaacttactaccttgacttcatctctagctgcagaaacactaagtctcaagggcttcagccccatgctggtcccttggtgttcagggagggtcacttggaccgctgttcatctggccgcccttgttgagtgttctttggaattgtcgttttttgagcacaactacagcattttagactgcatgaaaccatgactgactgagagtcactctctgggtagatgataggcgcctttctggccccttccctcacagattctttcccctcccctccacctgaagagaaggcctccaagtccttttggtgccttgtgaggacttttagaaggggcgttcagctttaaaaagccggtcctaattacggccggacgcagtagcttacgcctgttatcccagcactttgggaggtcgaggtgggcagatcacctgaggttaggagttcaagaccagcctggccaacatggtgaaaccccatctctactaaaaatacaaaaaattaggtgtagtggcaggcacctgtaatcccagctactcgggaggctgaggcaggagaatcgcttgaacctagaaggtggaggttgcagtgagcggagattgtaccatggcactccagcctggacaacaagagcgaaattctgtctaaaaaaacaaaagtcccaattaagaacctccgaactctgttttgaggcaaaggggagtagttcttggtaggtgcaggaatagtagtgtcatttggaatactggtcatctttctgacatcacagtagaaaccaaaccttggatttagattcaaaaggggggaaatgggtcttttcatcaaggcaactccccttctccaagtcacttacatcatagataaattttagcttcccagtaactgagggatttgtttcctaacgccattggaggccttcatccctctctacgataaggttgcagaaatgggaagagctacccgtggttgcttttgattacccttaggaagtgagacagtgtttttgaaaatatgtatttctcccatttctccctctccttccctgacacttctctgggctgcacagcagaaacgttggtaaaagggcagtttggtttcaacacagcagacctgatatgggatcccttagccactttagtcaaacagccctgacagagtctataattgagttcaggccccccaccttgcctaataactgcaaatcgcatgttcagccagcagcctcctaagcccaccttcctcccccattagagaacacccatcctaggtgctctccaggctgtgtcattggcagggcttcacatgcaggaggcctctctcaggtgagtccaggttaaactgttgagttgtggcttcaacagatatgtatggcatgctgggatgtgccaggtgcctgcgttgtgccagttgctggagaggtagtgtgagcagagcagctgaaatcttgccatcaagcaaccctcattctcatgcctgtaggtttccattgctctgtcccaggacacttgcgtgccagagacgccacaacttcatgtccctgtctcttgcaagctccccgtgctgccagtacttcatgccttggatgtggtcccaccagcccagtggccggggtcagcttaggctctgcttcccagtggacgggtgtgctaagggtttattttatgtaaaaaaaaaaaaaaaacaaaaaaaaaccctgagaccatgagtggggctggcatcttgccagcctgggcttcagggatgtttggggggggtggttagagggtagttgtagggtactttgtcacccccctccccctgccaccctccctggcacgtttatttcacagcagagccaagtctgtggcaggttgacacagactgtgttgccagagctgaaataattccacttcatcctatgagcgtgttgggctagcttgttctaattttggccactttggctgttttcttcagttttatgcattctctcctgccccaaagtgccaagccatttgtgaaggctctgccagacacctccaagcttgagagctcagcaccatgcaccaagagcaggagaaaagacgtaaacctaccccagcaactgtggcctctcgacagccctggctaactaacttacatttgtggggaagccaacagacacagcaggaggagagggaggtggcgctggtggaccaaggatctgtgctacccgctcccctccttggaggtgcagtgatgatgggagttatttttaccatccgggcgctgatagctgcactattaataaattgcatgtgttccttttgaaggtaggggatggttctgggtgagaggggagcaggctgagccggcgggggatctgctgtcctcccttttgagtcagttctaatcccatgtgtgtctgggccaccagaccgaaatggttgctgagaaacttgtctgttcatgtcccaaggcataacttcccaacatttaagaaaccccaatagacacctctgccctggccacgttcacagatccttctcttgaccggaaaccctgggaccctaagaacccctgaagcttggggtgggtgtgtgcttctggggtctcttttgggacctcctttgtcagtaccccttcttttttctaagcagctaataagaggttgggtgaaagagtgcatctcctcccaggattccacaacaaaattcttatcttccatggatgctttaattggaagtgggttgccgacccccttgtgcctagaaaaggcctttgcttgggtttcctttgtatgcttcagccttcctagttggtttttctaggcctggtgtgagaggtagggaagtctgcacataactaattcttttgcttaagggcctatggcacaagtgcacaaacttcaattcttgatgttctaagctctctcctctaacagagggagtgctgaaagcttttgagtcaagacaatggagtgctcttcctccctcactctgccttccgagcttatggttccttttctcaggagaggattttcaggattattggaggattaggtcattgtcagatgactggaaaacctaaataggatctctctccagctcaaggttgtcccagtgaggaagactttaccaacttctcactctaccccactactcacatgagtgttagctccaccttgcaaaggctgaagaccagttctccccagtgaaagctgcctcattcttttatggagttccctggagtggcagagctataaagacgagcattgggatttgcagtctccatgtagcctttcgtgcttggcaacccctgtaggctttttgtcccaagcagattgcgtgcgtgcgcctgtgtgtgagaataagtgccttactttgctgtgtggttttcaacttgtactccgtggccagcccccagttgccagggctcgacggcagccaaggacaccatacctcagtatagttatatataaaagggacacggattgtgacagtttcaccccatttgtttctaaccccgctgcccaggattagggtctgtggtgtgttctgttttgtttttggtttctcccttgtgtcagttctcttctggcccagctgggtggctgtggaagtctgtgaggtggcccaaccacaagcatacctattaagagaagcccagagcttccagcccccacttcgaaactctcctctggccccacatagcaaactccttctccgttattttccccacccccagttttttttaaaaggcccacttgccgtaacctcttttggtctattttgcttcccattcagcccaaagtttatatgataaaggtgtttacttttacttcccagtctccaagtgctaacacataaacacatacatgtctgactgttgcagaactgttcgagctcctaattcagtgttaccttgttttagtcgcagcaaccctctcccctaccccttgcccgcccacgtttttctcactcttccgggttgtgcaataactctcccagccagtggtcctttccacagcctttctgtcccttaaaacacctgcaactgggggagaaatgggacccatgggagggggagtcgtcatcccttacacaagaaatagccactttccttttgttgtcattcttgtgatcctgggtgggtttctgtggcactcttttagaacatgtagcatcatcttagaggtctatttttaaaaaatgtgttgaagaggaaaaaaccattctcacgatggggcttaagtcattgtccaggaataagattggcgtggtgcccatgacatcaccgtcactctgcctaaaagcactctagagctacttgttcacgtggagaggaaggatattttgcgaagcaacagccgcaggtggagagccctgttcacctgatagggtctagctgtgacagtaaatataataccgctgtttccttgggtacagatttgagtgttcatgtgatgagactgtaaacctcatttttcggttcctctgtttaaaaaaacatctgaaggatgaactaaggctgctggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgcttttggtgaactttttttcaaaatcatttttccactgtttctgtctggttttaaaacaaattacagttttgtatggattttttaaatgtacattttggaacaaatgatcaaatattttctgaaataacaataaaaggcagaa

SEQ ID NO: 332934 - DNA, 441 bp, Homo sapiens
cagatttccttgcccttttatgtccatgcatctgtccacacactcatataattatcaggcatttgttgacatcctctgtgtgcctagcactatgctaagacttggcaatacaaagatggtaatggaagattctttatcttcagtggttcattctcattctgaagagacagttatagacataagtaaggacagttgagagtgatgaacaccataacacagtatgtatcatctgctctgcaacccagaagaagaccctcaacagagacagccaggaagacttccagtggatgtcggcctttgaaccatggctttgcagcttgaaggcctcccaaagctgggctcttacctcacagtgtccaatgcaaacactgctagagctcgtagccctggaattcccttccctttggtttataatgacatggagagtaggtctctcttggt

SEQ ID NO: 332935 - DNA, 5445 bp, Homo sapiens
cacaaggaaagaatagggcacaggtatattgaaatctttaagagcagtagagctgaagttagaactcattatgatccaccacgaaagcttatggccatgcagcggccaggtccttatgacaggcctggggctggtaggcccttggtggtcctcatgtggatgggcaagaagagagcggccatctcggatcataatctccttggtgctgattaactgacgagatatatgattccagttctgcatgtaccatcttgaggcacagcagccactgctcgttgtaaatgccaaggcatttggctttgggacgtgacaactcaatccagaaggatggtgtgaactcggttgggtcccgtgactcgagctcctaccagtggctggccgcggattggaagccagcctgctgtcgctctgtggggggggacatgtcttcccactgcttagagcgagagcagagcaaactgcgcagcaggcacctccagaaaggtaatggtggcagaacccacagtggagtcgacctaggcctttctccagcagtcccagtcgccattgctttttcagccattcacaagcattcaaaaccaaaccaaacagcagttcatatacctgcctgagataggctggtcctcacctccagagccagccagccccgtcaggggccaaacttactaccttgacttcatctctagctgcagaaacactaagtctcaagggcttcagccccatgctggtcccttggtgttcagggagggtcacttggaccgctgttcatctggccgcccttgttgagtgttctttggaattgtcgttttttgagcacaactacagcattttagactgcatgaaaccatgactgactgagagtcactctctgggtagatgataggcgcctttctggccccttccctcacagattctttcccctcccctccacctgaagagaaggcctccaagtccttttggtgccttgtgaggacttttagaaggggcgttcagctttaaaaagccggtcctaattacggccggacgcagtagcttacgcctgttatcccagcactttgggaggtcgaggtgggcagatcacctgaggttaggagttcaagaccagcctggccaacatggtgaaaccccatctctactaaaaatacaaaaaattaggtgtagtggcaggcacctgtaatcccagctactcgggaggctgaggcaggagaatcgcttgaacctagaaggtggaggttgcagtgagcggagattgtaccatggcactccagcctggacaacaagagcgaaattctgtctaaaaaaacaaaagtcccaattaagaacctccgaactctgttttgaggcaaaggggagtagttcttggtaggtgcaggaatagtagtgtcatttggaatactggtcatctttctgacatcacagtagaaaccaaaccttggatttagattcaaaaggggggaaatgggtcttttcatcaaggcaactccccttctccaagtcacttacatcatagataaattttagcttcccagtaactgagggatttgtttcctaacgccattggaggccttcatccctctctacgataaggttgcagaaatgggaagagctacccgtggttgcttttgattacccttaggaagtgagacagtgtttttgaaaatatgtatttctcccatttctccctctccttccctgacacttctctgggctgcacagcagaaacgttggtaaaagggcagtttggtttcaacacagcagacctgatatgggatcccttagccactttagtcaaacagccctgacagagtctataattgagttcaggccccccaccttgcctaataactgcaaatcgcatgttcagccagcagcctcctaagcccaccttcctcccccattagagaacacccatcctaggtgctctccaggctgtgtcattggcagggcttcacatgcaggaggcctctctcaggtgagtccaggttaaactgttgagttgtggcttcaacagatatgtatggcatgctgggatgtgccaggtgcctgcgttgtgccagttgctggagaggtagtgtgagcagagcagctgaaatcttgccatcaagcaaccctcattctcatgcctgtaggtttccattgctctgtcccaggacacttgcgtgccagagacgccacaacttcatgtccctgtctcttgcaagctccccgtgctgccagtacttcatgccttggatgtggtcccaccagcccagtggccggggtcagcttaggctctgcttcccagtggacgggtgtgctaagggtttattttatgtaaaaaaaaaaaaaaaacaaaaaaaaaccctgagaccatgagtggggctggcatcttgccagcctgggcttcagggatgtttggggggggtggttagagggtagttgtagggtactttgtcacccccctccccctgccaccctccctggcacgtttatttcacagcagagccaagtctgtggcaggttgacacagactgtgttgccagagctgaaataattccacttcatcctatgagcgtgttgggctagcttgttctaattttggccactttggctgttttcttcagttttatgcattctctcctgccccaaagtgccaagccatttgtgaaggctctgccagacacctccaagcttgagagctcagcaccatgcaccaagagcaggagaaaagacgtaaacctaccccagcaactgtggcctctcgacagccctggctaactaacttacatttgtggggaagccaacagacacagcaggaggagagggaggtggcgctggtggaccaaggatctgtgctacccgctcccctccttggaggtgcagtgatgatgggagttatttttaccatccgggcgctgatagctgcactattaataaattgcatgtgttccttttgaaggtaggggatggttctgggtgagaggggagcaggctgagccggcgggggatctgctgtcctcccttttgagtcagttctaatcccatgtgtgtctgggccaccagaccgaaatggttgctgagaaacttgtctgttcatgtcccaaggcataacttcccaacatttaagaaaccccaatagacacctctgccctggccacgttcacagatccttctcttgaccggaaaccctgggaccctaagaacccctgaagcttggggtgggtgtgtgcttctggggtctcttttgggacctcctttgtcagtaccccttcttttttctaagcagctaataagaggttgggtgaaagagtgcatctcctcccaggattccacaacaaaattcttatcttccatggatgctttaattggaagtgggttgccgacccccttgtgcctagaaaaggcctttgcttgggtttcctttgtatgcttcagccttcctagttggtttttctaggcctggtgtgagaggtagggaagtctgcacataactaattcttttgcttaagggcctatggcacaagtgcacaaacttcaattcttgatgttctaagctctctcctctaacagagggagtgctgaaagcttttgagtcaagacaatggagtgctcttcctccctcactctgccttccgagcttatggttccttttctcaggagaggattttcaggattattggaggattaggtcattgtcagatgactggaaaacctaaataggatctctctccagctcaaggttgtcccagtgaggaagactttaccaacttctcactctaccccactactcacatgagtgttagctccaccttgcaaaggctgaagaccagttctccccagtgaaagctgcctcattcttttatggagttccctggagtggcagagctataaagacgagcattgggatttgcagtctccatgtagcctttcgtgcttggcaacccctgtaggctttttgtcccaagcagattgcgtgcgtgcgcctgtgtgtgagaataagtgccttactttgctgtgtggttttcaacttgtactccgtggccagcccccagttgccagggctcgacggcagccaaggacaccatacctcagtatagttatatataaaagggacacggattgtgacagtttcaccccatttgtttctaaccccgctgcccaggattagggtctgtggtgtgttctgttttgtttttggtttctcccttgtgtcagttctcttctggcccagctgggtggctgtggaagtctgtgaggtggcccaaccacaagcatacctattaagagaagcccagagcttccagcccccacttcgaaactctcctctggccccacatagcaaactccttctccgttattttccccacccccagttttttttaaaaggcccacttgccgtaacctcttttggtctattttgcttcccattcagcccaaagtttatatgataaaggtgtttacttttacttcccagtctccaagtgctaacacataaacacatacatgtctgactgttgcagaactgttcgagctcctaattcagtgttaccttgttttagtcgcagcaaccctctcccctaccccttgcccgcccacgtttttctcactcttccgggttgtgcaataactctcccagccagtggtcctttccacagcctttctgtcccttaaaacacctgcaactgggggagaaatgggacccatgggagggggagtcgtcatcccttacacaagaaatagccactttccttttgttgtcattcttgtgatcctgggtgggtttctgtggcactcttttagaacatgtagcatcatcttagaggtctatttttaaaaaatgtgttgaagaggaaaaaaccattctcacgatggggcttaagtcattgtccaggaataagattggcgtggtgcccatgacatcaccgtcactctgcctaaaagcactctagagctacttgttcacgtggagaggaaggatattttgcgaagcaacagccgcaggtggagagccctgttcacctgatagggtctagctgtgacagtaaatataataccgctgtttccttgggtacagatttgagtgttcatgtgatgagactgtaaacctcatttttcggttcctctgtttaaaaaaacatctgaaggatgaactaaggctgctggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgcttttggtgaactttttttcaaaatcatttttccactgtttctgtctggttttaaaacaaattacagttttgtatggattttttaaatgtacattttggaacaaatgatcaaatattttctgaaataacaataaaaggcagaa

SEQ ID NO: 332936 - DNA, 4320 bp, Homo sapiens
aatacctggggccatctccctcaggaggccaccctttgcctttcccgagatctttgttttttgtcttttttctgagatggagatttgctcttgttgcccagggtggagttgcagtgagcggagattgtaccatggcactccagcctggacaacaagagcgaaattctgtctaaaaaaacaaaagtcccaattaagaacctccgaactctgttttgaggcaaaggggagtagttcttggtaggtgcaggaatagtagtgtcatttggaatactggtcatctttctgacatcacagtagaaaccaaaccttggatttagattcaaaaggggggaaatgggtcttttcatcaaggcaactccccttctccaagtcacttacatcatagataaattttagcttcccagtaactgagggatttgtttcctaacgccattggaggccttcatccctctctacgataaggttgcagaaatgggaagagctacccgtggttgcttttgattacccttaggaagtgagacagtgtttttgaaaatatgtatttctcccatttctccctctccttccctgacacttctctgggctgcacagcagaaacgttggtaaaagggcagtttggtttcaacacagcagacctgatatgggatcccttagccactttagtcaaacagccctgacagagtctataattgagttcaggccccccaccttgcctaataactgcaaatcgcatgttcagccagcagcctcctaagcccaccttcctcccccattagagaacacccatcctaggtgctctccaggctgtgtcattggcagggcttcacatgcaggaggcctctctcaggtgagtccaggttaaactgttgagttgtggcttcaacagatatgtatggcatgctgggatgtgccaggtgcctgcgttgtgccagttgctggagaggtagtgtgagcagagcagctgaaatcttgccatcaagcaaccctcattctcatgcctgtaggtttccattgctctgtcccaggacacttgcgtgccagagacgccacaacttcatgtccctgtctcttgcaagctccccgtgctgccagtacttcatgccttggatgtggtcccaccagcccagtggccggggtcagcttaggctctgcttcccagtggacgggtgtgctaagggtttattttatgtaaaaaaaaaaaaaaaacaaaaaaaaaccctgagaccatgagtggggctggcatcttgccagcctgggcttcagggatgtttggggggggtggttagagggtagttgtagggtactttgtcacccccctccccctgccaccctccctggcacgtttatttcacagcagagccaagtctgtggcaggttgacacagactgtgttgccagagctgaaataattccacttcatcctatgagcgtgttgggctagcttgttctaattttggccactttggctgttttcttcagttttatgcattctctcctgccccaaagtgccaagccatttgtgaaggctctgccagacacctccaagcttgagagctcagcaccatgcaccaagagcaggagaaaagacgtaaacctaccccagcaactgtggcctctcgacagccctggctaactaacttacatttgtggggaagccaacagacacagcaggaggagagggaggtggcgctggtggaccaaggatctgtgctacccgctcccctccttggaggtgcagtgatgatgggagttatttttaccatccgggcgctgatagctgcactattaataaattgcatgtgttccttttgaaggtaggggatggttctgggtgagaggggagcaggctgagccggcgggggatctgctgtcctcccttttgagtcagttctaatcccatgtgtgtctgggccaccagaccgaaatggttgctgagaaacttgtctgttcatgtcccaaggcataacttcccaacatttaagaaaccccaatagacacctctgccctggccacgttcacagatccttctcttgaccggaaaccctgggaccctaagaacccctgaagcttggggtgggtgtgtgcttctggggtctcttttgggacctcctttgtcagtaccccttcttttttctaagcagctaataagaggttgggtgaaagagtgcatctcctcccaggattccacaacaaaattcttatcttccatggatgctttaattggaagtgggttgccgacccccttgtgcctagaaaaggcctttgcttgggtttcctttgtatgcttcagccttcctagttggtttttctaggcctggtgtgagaggtagggaagtctgcacataactaattcttttgcttaagggcctatggcacaagtgcacaaacttcaattcttgatgttctaagctctctcctctaacagagggagtgctgaaagcttttgagtcaagacaatggagtgctcttcctccctcactctgccttccgagcttatggttccttttctcaggagaggattttcaggattattggaggattaggtcattgtcagatgactggaaaacctaaataggatctctctccagctcaaggttgtcccagtgaggaagactttaccaacttctcactctaccccactactcacatgagtgttagctccaccttgcaaaggctgaagaccagttctccccagtgaaagctgcctcattcttttatggagttccctggagtggcagagctataaagacgagcattgggatttgcagtctccatgtagcctttcgtgcttggcaacccctgtaggctttttgtcccaagcagattgcgtgcgtgcgcctgtgtgtgagaataagtgccttactttgctgtgtggttttcaacttgtactccgtggccagcccccagttgccagggctcgacggcagccaaggacaccatacctcagtatagttatatataaaagggacacggattgtgacagtttcaccccatttgtttctaaccccgctgcccaggattagggtctgtggtgtgttctgttttgtttttggtttctcccttgtgtcagttctcttctggcccagctgggtggctgtggaagtctgtgaggtggcccaaccacaagcatacctattaagagaagcccagagcttccagcccccacttcgaaactctcctctggccccacatagcaaactccttctccgttattttccccacccccagttttttttaaaaggcccacttgccgtaacctcttttggtctattttgcttcccattcagcccaaagtttatatgataaaggtgtttacttttacttcccagtctccaagtgctaacacataaacacatacatgtctgactgttgcagaactgttcgagctcctaattcagtgttaccttgttttagtcgcagcaaccctctcccctaccccttgcccgcccacgtttttctcactcttccgggttgtgcaataactctcccagccagtggtcctttccacagcctttctgtcccttaaaacacctgcaactgggggagaaatgggacccatgggagggggagtcgtcatcccttacacaagaaatagccactttccttttgttgtcattcttgtgatcctgggtgggtttctgtggcactcttttagaacatgtagcatcatcttagaggtctatttttaaaaaatgtgttgaagaggaaaaaaccattctcacgatggggcttaagtcattgtccaggaataagattggcgtggtgcccatgacatcaccgtcactctgcctaaaagcactctagagctacttgttcacgtggagaggaaggatattttgcgaagcaacagccgcaggtggagagccctgttcacctgatagggtctagctgtgacagtaaatataataccgctgtttccttgggtacagatttgagtgttcatgtgatgagactgtaaacctcatttttcggttcctctgtttaaaaaaacatctgaaggatgaactaaggctgctggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgcttttggtgaactttttttcaaaatcatttttccactgtttctgtctggttttaaaacaaattacagttttgtatggattttttaaatgtacattttggaacaaatgatcaaatattttctgaaataacaataaaaggcagaa

SEQ ID NO: 332937 - DNA, 6992 bp, Homo sapiens
ccccgaagttgttccgcgctgggcgggcgagcggctgtgggagagcgggcggcgggccggcgggcggaccgggccggtgctggagaagtttgcgctgcggttcgtgagcgcagggtgcgggccccgccggccgctgcgcgcccgctgccatggctttccgcaggaggacgaaaagttacccgctcttcagccaggagttcgtcatccacaaccatgcggacatcggcttctgcctggtgctctgcgtcctcatcgggcttatgttcgaggtcacagccaagactgcctttctatttattttacctcagtataacattagcgtgcctacagcagacagtgagaccgtgcactaccactatggccctaaggacctggtcacaatcttgttctacatcttcatcaccatcatcttgcatgctgtggttcaggagtacattttagataaaatcagcaaacggcttcatctctccaaagtcaaacacagcaagttcaatgaatctggacagctggtcgtctttcatttcacctcggtgatttggtgcttctacgtggtggtgacggaaggatacttaacaaacccaagaagcctctgggaagactacccgcatgtgcacctccccttccaggtgaagtttttctacctatgccagctggcctactggctgcacgcacttcctgagctatacttccagaaggtacggaaggaggaaattccccgccagctccagtatatttgcctgtacctggtgcatatagctggagcatacctcttaaacctgagccgcctgggcctgatcttgctgctgctgcagtactcaactgagttcctcttccacacggctagactcttctactttgcagatgaaaacaacgagaaactgttcagtgcctgggctgctgtttttggggttacccgcctcttcatcctcacccttgccgtgctggccattggctttggactggctcgcatggaaaaccaggcatttgatcccgagaaagggaacttcaacactttgttttgcaggctctgcgtgctgctgctggtgtgtgccgcccaggcctggctcatgtggcgcttcatccactcccagctgcggcactggcgggaatactggaatgagcagagtgcaaagcggagagtcccagccacacccagactaccagccaggctcatcaagagggaatctggttaccatgaaaatggagtggtgaaggcagagaacggaacctccccacggactaagaaactcaagtctccctaaggccaaagtgctaagaacaggaatcctcttggtgggggccgagcagggggcaaggagcccaggccccctccctgcctcctccttcctgcctgtgatgctccgtctcaaacagccgaaacctgtcttgcaatggggggagggggcgtttcgctttccttcttcttggcttcctcttattcttccacaaaccattctcaataaagccaaaaatctttctctttctccccctcaggccacctcctgtcctcactcctgtcctgtgctggcttttctggaacgccaggcgcccatggctggcacctttctgcttgctctgtttcttgccttatggctgctgcttttcctttttacttcctattttcaccttatcttgcaatttttctgtctgatttttacaatgggaggggagctaagattgcagtcctgtccttcggtcccccagggcctgccggtcagaagcctggggctggtaggcccttggtggtcctcatgtggatgggcaagaagagagcggccatctcggatcataatctccttggtgctgattaactgacgagatatatgattccagttctgcatgtaccatcttgaggcacagcagccactgctcgttgtaaatgccaaggcatttggctttgggacgtgacaactcaatccagaaggatggtgtgaactcggttgggtcccgtgactcgagctcctaccagtggctggccgcggattggaagccagcctgctgtcgctctgtggggggggacatgtcttcccactgcttagagcgagagcagagcaaactgcgcagcaggcacctccagaaaggtaatggtggcagaacccacagtggagtcgacctaggcctttctccagcagtcccagtcgccattgctttttcagccattcacaagcattcaaaaccaaaccaaacagcagttcatatacctgcctgagataggctggtcctcacctccagagccagccagccccgtcaggggccaaacttactaccttgacttcatctctagctgcagaaacactaagtctcaagggcttcagccccatgctggtcccttggtgttcagggagggtcacttggaccgctgttcatctggccgcccttgttgagtgttctttggaattgtcgttttttgagcacaactacagcattttagactgcatgaaaccatgactgactgagagtcactctctgggtagatgataggcgcctttctggccccttccctcacagattctttcccctcccctccacctgaagagaaggcctccaagtccttttggtgccttgtgaggacttttagaaggggcgttcagctttaaaaagccggtcctaattacggccggacgcagtagcttacgcctgttatcccagcactttgggaggtcgaggtgggcagatcacctgaggttaggagttcaagaccagcctggccaacatggtgaaaccccatctctactaaaaatacaaaaaattaggtgtagtggcaggcacctgtaatcccagctactcgggaggctgaggcaggagaatcgcttgaacctagaaggtggaggttgcagtgagcggagattgtaccatggcactccagcctggacaacaagagcgaaattctgtctaaaaaaacaaaagtcccaattaagaacctccgaactctgttttgaggcaaaggggagtagttcttggtaggtgcaggaatagtagtgtcatttggaatactggtcatctttctgacatcacagtagaaaccaaaccttggatttagattcaaaaggggggaaatgggtcttttcatcaaggcaactccccttctccaagtcacttacatcatagataaattttagcttcccagtaactgagggatttgtttcctaacgccattggaggccttcatccctctctacgataaggttgcagaaatgggaagagctacccgtggttgcttttgattacccttaggaagtgagacagtgtttttgaaaatatgtatttctcccatttctccctctccttccctgacacttctctgggctgcacagcagaaacgttggtaaaagggcagtttggtttcaacacagcagacctgatatgggatcccttagccactttagtcaaacagccctgacagagtctataattgagttcaggccccccaccttgcctaataactgcaaatcgcatgttcagccagcagcctcctaagcccaccttcctcccccattagagaacacccatcctaggtgctctccaggctgtgtcattggcagggcttcacatgcaggaggcctctctcaggtgagtccaggttaaactgttgagttgtggcttcaacagatatgtatggcatgctgggatgtgccaggtgcctgcgttgtgccagttgctggagaggtagtgtgagcagagcagctgaaatcttgccatcaagcaaccctcattctcatgcctgtaggtttccattgctctgtcccaggacacttgcgtgccagagacgccacaacttcatgtggtcccaccagcccagtggccggggtcagcttaggctctgcttcccagtggacgggtgtgctaagggtttattttatgtaaaaaaaaaaaaaaaacaaaaaaaaaccctgagaccatgagtggggctggcatcttgccagcctgggcttcagggatgtttggggggggtggttagagggtagttgtagggtactttgtcacccccctccccctgccaccctccctggcacgtttatttcacagcagagccaagtctgtggcaggttgacacagactgtgttgccagagctgaaataattccacttcatcctatgagcgtgttgggctagcttgttctaattttggccactttggctgttttcttcagttttatgcattctctcctgccccaaagtgccaagccatttgtgaaggctctgccagacacctccaagcttgagagctcagcaccatgcaccaagagcaggagaaaagacgtaaacctaccccagcaactgtggcctctcgacagccctggctaactaacttacatttgtggggaagccaacagacacagcaggaggagagggaggtggcgctggtggaccaaggatctgtgctacccgctcccctccttggaggtgcagtgatgatgggagttatttttaccatccgggcgctgatagctgcactattaataaattgcatgtgttccttttgaaggtaggggatggttctgggtgagaggggagcaggctgagccggcgggggatctgctgtcctcccttttgagtcagttctaatcccatgtgtgtctgggccaccagaccgaaatggttgctgagaaacttgtctgttcatgtcccaaggcataacttcccaacatttaagaaaccccaatagacacctctgccctggccacgttcacagatccttctcttgaccggaaaccctgggaccctaagaacccctgaagcttggggtgggtgtgtgcttctggggtctcttttgggacctcctttgtcagtaccccttcttttttctaagcagctaataagaggttgggtgaaagagtgcatctcctcccaggattccacaacaaaattcttatcttccatggatgctttaattggaagtgggttgccgacccccttgtgcctagaaaaggcctttgcttgggtttcctttgtatgcttcagccttcctagttggtttttctaggcctggtgtgagaggtagggaagtctgcacataactaattcttttgcttaagggcctatggcacaagtgcacaaacttcaattcttgatgttctaagctctctcctctaacagagggagtgctgaaagcttttgagtcaagacaatggagtgctcttcctccctcactctgccttccgagcttatggttccttttctcaggagaggattttcaggattattggaggattaggtcattgtcagatgactggaaaacctaaataggatctctctccagctcaaggttgtcccagtgaggaagactttaccaacttctcactctaccccactactcacatgagtgttagctccaccttgcaaaggctgaagaccagttctccccagtgaaagctgcctcattcttttatggagttccctggagtggcagagctataaagacgagcattgggatttgcagtctccatgtagcctttcgtgcttggcaacccctgtaggctttttgtcccaagcagattgcgtgcgtgcgcctgtgtgtgagaataagtgccttactttgctgtgtggttttcaacttgtactccgtggccagcccccagttgccagggctcgacggcagccaaggacaccatacctcagtatagttatatataaaagggacacggattgtgacagtttcaccccatttgtttctaaccccgctgcccaggattagggtctgtggtgtgttctgttttgtttttggtttctcccttgtgtcagttctcttctggcccagctgggtggctgtggaagtctgtgaggtggcccaaccacaagcatacctattaagagaagcccagagcttccagcccccacttcgaaactctcctctggccccacatagcaaactccttctccgttattttccccacccccagttttttttaaaaggcccacttgccgtaacctcttttggtctattttgcttcccattcagcccaaagtttatatgataaaggtgtttacttttacttcccagtctccaagtgctaacacataaacacatacatgtctgactgttgcagaactgttcgagctcctaattcagtgttaccttgttttagtcgcagcaaccctctcccctaccccttgcccgcccacgtttttctcactcttccgggttgtgcaataactctcccagccagtggtcctttccacagcctttctgtcccttaaaacacctgcaactgggggagaaatgggacccatgggagggggagtcgtcatcccttacacaagaaatagccactttccttttgttgtcattcttgtgatcctgggtgggtttctgtggcactcttttagaacatgtagcatcatcttagaggtctatttttaaaaaatgtgttgaagaggaaaaaaccattctcacgatggggcttaagtcattgtccaggaataagattggcgtggtgcccatgacatcaccgtcactctgcctaaaagcactctagagctacttgttcacgtggagaggaaggatattttgcgaagcaacagccgcaggtggagagccctgttcacctgatagggtctagctgtgacagtaaatataataccgctgtttccttgggtacagatttgagtgttcatgtgatgagactgtaaacctcatttttcggttcctctgtttaaaaaaacatctgaaggatgaactaaggctgctggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgcttttggtgaactttttttcaaaatcatttttccactgtttctgtctggttttaaaacaaattacagttttgtatggattttttaaatgtacattttggaacaaatgatcaaatattttctgaaataacaataaaaggcagaa

SEQ ID NO: 332938 - DNA, 440 bp, Homo sapiens
ttcatttcacctcggtgatttggtgcttctacgtggtggtgacggtgagccattctcaggactgctgaagcgggagagctcaaaccaaggggcaattccagctctgggattgctaatcaaatgactgcaaaggaccccttgctctttttctttttctgttaaggggaacaagtttcttagaaccttcttagcttcttagaactgaagctatgtttgcatcctcatggtattacagagagatgccattttatagctggagagagtcatcttggccaacagtcaccacttgttataatcattatgcaatactgcagtaatgataccatgtatctacataatactgtattgttttacaaggctcttctacaaacactgtcccataagatacatttgatgttcattctgatacccatgttacagattgaagagttccaagctca

SEQ ID NO: 332939 - DNA, 415 bp, Homo sapiens
cctagcactatgctaagacttggcaatacaaagatggtaatggaagattctttatcttcagtggttcattctcattctgaagagacagttatagacataagtaaggacagttgagagtgatgaacaccataacacagtatgtatcatctgctctgcaacccagaagaagaccctcaacagagacagccaggaagacttccagtggatgtcggcctttgaaccatggctttgcagcttgaaggcctcccaaagctgggctcttacctcacagtgtccaatgcaaacactgctagagctcgtagccctggaattcccttccctttggtttataatgacatggagagtaggtctctcttggttgttctagaggcagaaagaattgctataatattagttctcgaagagcctcttttat

SEQ ID NO: 332940 - DNA, 474 bp, Homo sapiens
cttctgaattatttccaagagccctcttctccagtccctgtctcttatttctcaatccaaacctcaccctctgacactagacccaaggctgctggaatttgggaatggacctgaatgcccttgaatttcagcagcctggtgcagtgggactgtgggactcgtgggacatgggactgtgtgttaaagcagcccagaggagcctggccctctctcatccccctgcacttttcccccttccctgaatcttcagttagggaattagcaaatttaccatctgcttctcttgtttccaggaggaaattccccgccagctccagtatatttgcctgtacctggtgcatatagctggagcatacctcttaaagtgagtgagaccatggagccagccagatttccttgcccttttatgtccatgcatctgtccacacactcatataattatcaggcatttgttgacatcctctgtgtgcctag

SEQ ID NO: 332941 - DNA, 4729 bp, Homo sapiens
  misc_feature (4705)..(4705): n is a, c, g, or t
  misc_feature (4714)..(4714): n is a, c, g, or t
ccccgaagttgttccgcgctgggcgggcgagcggctgtgggagagcgggcggcgggccggcgggcggaccgggccggtgctggagaagtttgcgctgcggttcgtgagcgcagggtgcgggccccgccggccgctgcgcgcccgctgccatggctttccgcaggaggacgaaaagttacccgctcttcagccaggagttcgtcatccacaaccatgcggacatcggcttctgcctggtgctctgcgtcctcatcgggcttatgttcgaggtcacagccaagactgcctttctatttattttacctcagtataacattagcgtgcctacagcagacagtgagaccgtgcactaccactatggccctaaggacctggtcacaatcttgttctacatcttcatcaccatcatcttgcatgctgtggttcaggagtacattttagataaaatcagcaaacggcttcatctctccaaagtcaaacacagcaagttcaatgaatctggacagctggtcgtctttcatttcacctcggtgatttggtgcttctacgtggtggtgacggaaggatacttaacaaacccaagaagcctctgggaagactacccgcatgtgcacctccccttccaggtgaagtttttctacctatgccagctggcctactggctgcacgcacttcctgagctatacttccagaaggtacggaaggaggaaattccccgccagctccagtatatttgcctgtacctggtgcatatagctggagcatacctcttaaacctgagccgcctgggcctgatcttgctgctgctgcagtactcaactgagttcctcttccacacggctagactcttctactttgcagatgaaaacaacgagaaactgttcagtgcctgggctgctgtttttggggttacccgcctcttcatcctcacccttgccgtgctggccattggctttggactggctcgcatggaaaaccaggcatttgatcccgagaaagggaacttcaacactttgttttgcaggctctgcgtgctgctgctggtgtgtgccgcccaggcctggctcatgtggcgcttcatccactcccagctgcggcactggcgggaatactggaatgagcagagtgcaaagcggagagtcccagccacacccagactaccagccaggctcatcaagagggaatctggttaccatgaaaatggagtggtgaaggcagagaacggaacctccccacggactaagaaactcaagtctccctaaggccaaagtgctaagaacaggaatcctcttggtgggggccgagcagggggcaaggagcccaggccccctccctgcctcctccttcctgcctgtgatgctccgtctcaaacagccgaaacctgtcttgcaatggggggagggggcgtttcgctttccttcttcttggcttcctcttattcttccacaaaccattctcaataaagccaaaaatctttctctttctccccctcaggccacctcctgtcctcactcctgtcctgtgctggcttttctggaacgccaggcgcccatggctggcacctttctgcttgctctgtttcttgccttatggctgctgcttttcctttttacttcctattttcaccttatcttgcaatttttctgtctgatttttacaatgggaggggagctaagattgcagtcctgtccttcggtcccccagggcctgccggtcagaagcctggggctggtaggcccttggtggtcctcatgtggatgggcaagaagagagcggccatctcggatcataatctccttggtgctgattaactgacgagatatatgattccagttctgcatgtaccatcttgaggcacagcagccactgctcgttgtaaatgccaaggcatttggctttgggacgtgacaactcaatccagaaggatggtgtgaactcggttgggtcccgtgactcgagctcctaccagtggctggccgcggattggaagccagcctgctgtcgctctgtggggggggacatgtcttcccactgcttagagcgagagcagagcaaactgcgcagcaggcacctccagaaaggtaatggtggcagaacccacagtggagtcgacctaggcctttctccagcagtcccagtcgccattgctttttcagccattcacaagcattcaaaaccaaaccaaacagcagttcatatacctgcctgagataggctggtcctcacctccagagccagccagccccgtcaggggccaaacttactaccttgacttcatctctagctgcagaaacactaagtctcaagggcttcagccccatgctggtcccttggtgttcagggagggtcacttggaccgctgttcatctggccgcccttgttgagtgttctttggaattgtcgttttttgagcacaactacagcattttagactgcatgaaaccatgactgactgagagtcactctctgggtagatgataggcgcctttctggccccttccctcacagattctttcccctcccctccacctgaagagaaggcctccaagtccttttggtgccttgtgaggacttttagaaggggcgttcagctttaaaaagccggtcctaattacggccggacgcagtagcttacgcctgttatcccagcactttgggaggtcgaggtgggcagatcacctgaggttaggagttcaagaccagcctggccaacatggtgaaaccccatctctactaaaaatacaaaaaattaggtgtagtggcaggcacctgtaatcccagctactcgggaggctgaggcaggagaatcgcttgaacctagaaggtggaggttgcagtgagcggagattgtaccatggcactccagcctggacaacaagagcgaaattctgtctaaaaaaacaaaagtcccaattaagaacctccgaactctgttttgaggcaaaggggagtagttcttggtaggtgcaggaatagtagtgtcatttggaatactggtcatctttctgacatcacagtagaaaccaaaccttggatttagattcaaaaggggggaaatgggtcttttcatcaaggcaactccccttctccaagtcacttacatcatagataaattttagcttcccagtaactgagggatttgtttcctaacgccattggaggccttcatccctctctacgataaggttgcagaaatgggaagagctacccgtggttgcttttgattacccttaggaagtgagacagtgtttttgaaaatatgtatttctcccatttctccctctccttccctgacacttctctgggctgcacagcagaaacgttggtaaaagggcagtttggtttcaacacagcagacctgatatgggatcccttagccactttagtcaaacagccctgacagagtctataattgagttcaggccccccaccttgcctaataactgcaaatcgcatgttcagccagcagcctcctaagcccaccttcctcccccattagagaacacccatcctaggtgctctccaggctgtgtcattggcagggcttcacatgcaggaggcctctctcaggtgagtccaggttaaactgttgagttgtggcttcaacagatatgtatggcatgctgggatgtgccaggtgcctgcgttgtgccagttgctggagaggtagtgtgagcagagcagctgaaatcttgccatcaagcaaccctcattctcatgcctgtaggtttccattgctctgtcccaggacacttgcgtgccagagacgccacaacttcatgtccctgtctcttgcaagctccccgtgctgccagtacttcatgccttggatgtggtcccaccagcccagtggccggggtcagcttaggctctgcttcccagtggacgggtgtgctaagggtttattttatgtaaaaaaaaaaaaaaaacaaaaaaaaaccctgagaccatgagtggggctggcatcttgccagcctgggcttcagggatgtttggggggggtggttagagggtagttgtagggtactttgtcacccccctccccctgccaccctccctggcacgtttatttcacagcagagccaagtctgtggcaggttgacacagactgtgttgccagagctgaaataattccacttcatcctatgagcgtgttgggctagcttgttctaattttggccactttggctgttttcttcagttttatgcattctctcctgccccaaagtgccaagccatttgtgaaggctctgccagacacctccaagcttgagagctcagcaccatgcaccaagagcaggagaaaagacgtaaacctaccccagcaactgtggcctctcgacagccctggctaactaacttacatttgtggggaagccaacagacacagcaggaggagagggaggtggcgctggtggaccaaggatctgtgctacccgctcccctccttggaggtgcagtgatgatgggagttatttttaccatccgggcgctgatagctgcactattaataaattgcatgtgttccttttgaaggtaggggatggttctgggtgagaggggagcaggctgagccggcgggggatctgctgtcctcccttttgagtcagttctaatcccatgtgtgtctgggccaccagaccgaaatggttgctgagaaacttgtctgttcatgtcccaaggcataacttcccaacaatataanctcgtcccnattccatgcaaccca

SEQ ID NO: 332942 - DNA, 1931 bp, Homo sapiens
agcggctctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtgcagaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggtt

SEQ ID NO: 332943 - DNA, 915 bp, Homo sapiens
agcggctctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtgcagaggtccgcagggtggggcatggggcaggctcacatgtctggggagggccaatgtgtccctgagctcgtactaggcggcctgtgggtgtttggctctctcacacgtgagagtagtggtaggacttgtcacagactaaacccaacaccacccagcctatggcgtcttctcctcaaggcttgtgtccagccagcacagaggtatcttgggactgggggccgaggggcttggcctggccctgcttcctgttcagaggcacaggtgcctcatcactgccagaacctgccaggagccagccccaggcacagaagcattgttcatccacatcctggcagaggggtacaccag

SEQ ID NO: 332944 - DNA, 543 bp, Homo sapiens
gaggttatccgctccaatagtgagaagtggagaccccagcctctgaattcacaggggcccctgcctgactggccgcctccctctttgcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggtt

SEQ ID NO: 332945 - DNA, 672 bp, Homo sapiens
ggtgggcgtaggacagccgttattatcctgttactccttttatgatggtggtgtcggattttcttctgaaataagtctccgtcagtaaaacatgtggattaaagaaaaatgccaagcttgtgctagtatgtggcagaggctgtggtaggtctgtaaaggacaggagtccagggcgccgtgggctgggtagcagtcacatgggtccacatatgtaactgcatccctcacacccatccaggaaaaggccgtggccggcaggtgatcgctgtggcgcgcacggctgacgtcatcatcatgatgctggatgccaccaagggagaggtgcagaggtccgcagggtggggcatggggcaggctcacatgtctggggagggccaatgtgtccctgagctcgtactaggcggcctgtgggtgtttggctctctcacacgtgagagtagtggtaggacttgtcacagactaaacccaacaccacccagcctatggcgtcttctcctcaaggcttgtgtccagccagcacagaggtatcttgggactgggggccgaggggcttggcctggccctgcttcctgttcagaggcacaggtgcctcatcactgccagaacctgccaggagccagccccaggcacagaagcattgttcatccacatcctggcagaggggtacaccag

SEQ ID NO: 332946 - DNA, 1841 bp, Homo sapiens
agcggctctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttctggatgccaccaagggagaggtgcagaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggtt

SEQ ID NO: 332947 - DNA, 1320 bp, Homo sapiens
agcggctctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtgcagaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctca

SEQ ID NO: 332948 - DNA, 1350 bp, Homo sapiens
agcggctctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggtt

SEQ ID NO: 332949 - DNA, 1110 bp, Homo sapiens
gaggttatccgctccaatagtgagaagtggagaccccagcctctgaattcacaggggcccctgcctgactggccgcctccctctttgcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggtt

SEQ ID NO: 332950 - DNA, 610 bp, Homo sapiens
gagtggtcacatccacatcttcccagttccccactccctccctgcgacacctctcctgtcagctgtctctgcctcagcccaggaggttgacatctccttgcacacctccttacaccctccctgggtgcacagcatgtctgggtactggttccacgagtgccgtgggactgccacctgcttaaagttctctggggccaagagggcctggaggattgtgtggggttaggagaggctcctgatgtatatggggaaccccatcagaatccagatccctgcctctacctgagacagtcctgaggcctccaaggaacagatgggcctctggtgtctgacccatccaggacagggccagaggtgagccctctggctgggaggtctcttcacagccacctaggtcaccaagccgagggtgagagggtctcctcctgctgcctgcacctgcaggcccccagcccctggggcctctcccagaaggccagggacaaggctcctcagtgcaatgatctccttttctcctagttccacattcttgagtctgatgacctccacggccagcgaggcagcgtcctatgagttcaccactctgacgtgtattcctggggtcattgaa

SEQ ID NO: 332951 - DNA, 307 bp, Homo sapiens
ggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggttcctgttcagactgagaacac

SEQ ID NO: 332952 - DNA, 953 bp, Homo sapiens
ttctccccatcctgccctgcagagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggtt

SEQ ID NO: 332953 - DNA, 617 bp, Homo sapiens
  misc_feature (617)..(617): n is a, c, g, or t
agcggctctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtgcagaggacaaggagtctgattttctttgtggacatccgcctcataactan

SEQ ID NO: 332954 - DNA, 1839 bp, Homo sapiens
  misc_feature (212)..(212): n is a, c, g, or t
  misc_feature (223)..(223): n is a, c, g, or t
  misc_feature (308)..(308): n is a, c, g, or t
  misc_feature (391)..(391): n is a, c, g, or t
acaggcgagacgtgagacctcggatttatttgtcgctggcacttgctatccacggtctctctgggatacggacgagtgtgcggtgggcacttcagggtaaggatagcctccggggattggccgtttggggctcgatagcgttctgtcgcgtgtgcgctacttccacgattgtggcctctgtctgcgctgcaccgtggccgcgcagtgcaganagtccgtatgntaatcttgaccaacatcgtgtgacggtgtgataccatggagggtccatggaagtacgcaaggtggcgccaatcaatacgcatccntccgtggggacctgatgcttgcgcacagtcgatggcaacgacgcaactcgcagggtgaatgaggactcggctggacggtgaangggctgatcggctggttggccgcggcacctgggttagcgtcagtcatcatagatgctaggattgccaccaaagggacacggtgcagacggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggtt

SEQ ID NO: 332955 - DNA, 1828 bp, Homo sapiens
tgctacttaaggcgtcgtggcctcccctgccccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagta

SEQ ID NO: 332956 - DNA, 686 bp, Homo sapiens
atagtaatgactaactattttttaggcatttccataagcttccaagcctcctctcttgtgatgatgtaaacatgagaatagctgctggtgaatctttggcacttctctttgaattggccagaggaatagagagtgtaagtatctaactggcagaggaaaaagcttgtgtcacaaggcccattgttccatcattaccttgcaattgagaattgggcaataactttggaacatggccagcttgagaacccagtgatttatttccctacttcttggcagtggtggtgtaatactttagagagcagaaaccagtaggggttggtacagcagtgtttgactgtggttcattatacttaatttttgctatctatagaactgaagtttagggatcctcatggagagagttttgtctaatataatctttatgaaactgcttgaatttctcagatacccaatacatcaagctaatgaaggcatgtgatgcttcataattaatatcaaacaaatgaataaccaaagatggaaataaacactgctcattaagactgggacatgtgctttgcagttacccattcacttgtccactcacagatgttagttaccatggcttggctctcgaagggatttgagtttgtgatagtttgatcagtcgacccaatttgctttgtacctgtttttggtttagcact

SEQ ID NO: 332957 - DNA, 392 bp, Homo sapiens
taatacaatgtaagtgctatgtaaatagttgttatactttattgtttagggaatagtggaaagaaagaatagtctatacatgttcagtatagttgcaatttttttctgaatattttcagtccatggttggttgaatccgtgatgcagaaccaaccagatatggaggattgactatatatgtaaaagattgagattaaccttgaattgtggagggacagaggtttgtctgttaccaacaggaaagaggataataggtaaggatgctgatgactttatagagggttggtgggaaacagttctttcttggtgccttaatgttttctgaattaaagaagattgaaataagataactctactgttatttatttatttatttttgagctgctgttacg

SEQ ID NO: 332958 - DNA, 2512 bp, Homo sapiens
agcgggttaaaaccagactgcactccttctggctcctggttcattcaaggtctacatagttaaaggttgttccagagggatgtgtgtaattcctcccagtatttgatgttcctttattacttattttcacttgagccaacagcctgaactggtcaggctttgggctgatgccagctgctttatctggtagcactgttacataaaattaacatttattggtgatcactaggtgccaacattatgcgaagaactttacgtggacatcccatttaattctcagaagccgatcacaagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaaaaaaaaaa

SEQ ID NO: 332959 - DNA, 1991 bp, Homo sapiens
attgtaatgtgttttaaaggctttttgatagagggtaggcttctttaaagctttctatctttgaattacagttgaagtttaatgatctagtaagcacctgtaaagcatacagaaaggaaacaaggggatagttcaccctttcagaatgctttactgacatagactcataaaaatgattcaataatttaaattatagattatggagctgcaattgtttcagaaattatgtaattcttttgcatgcttttgattttatggatcaataaaagaagactgaagaggaacagaatcactttgttaaagtcatgctgtgaatttagtagcagagcttgagctgaaacgcacttcctttgatcttagttcaatattctttctctcctcacctcttttatgtataatgtttgggacctaatatattatgctgctgagaacattttcacgttgaattataaaagcaggaagatgtagaattaataagaaataaaatcattaatgtctatatatatatattttttttttagtgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaaaaaaaaaa

SEQ ID NO: 332960 - DNA, 2069 bp, Homo sapiens
  misc_feature (1954)..(1955): n is a, c, g, or t
  misc_feature (1958)..(1959): n is a, c, g, or t
  misc_feature (1963)..(1963): n is a, c, g, or t
  misc_feature (1979)..(1979): n is a, c, g, or t
  misc_feature (1997)..(1997): n is a, c, g, or t
  misc_feature (1999)..(1999): n is a, c, g, or t
tgctacttaaggcgtcgtggcctcccctgccccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactatatgnnttnntggnagaattattattttgnacagttgggcattgggtnantccggaaaacgtcggtaataaggagagcaaccgcgggccaaggaaaagcgacactgtgtaacaacggggc

SEQ ID NO: 332961 - DNA, 1435 bp, Homo sapiens
ctttgaaatcccagtaatgtcttatatatggtgggaacacaagaaatatttgttggatgcatttacttggaagggaaatgttaattgttttgctgtagtacatcatcttgtagtcagcatttctgggttcgatttttgcatgaaaacatgtgtttatgtgtgcctagtccctaaataccatgaagatttacattgccttatgcaactggatattttccaaatgtagactgttctttgttagctctatatgaggtcagaaaagaaaaataataataaaggaaacaaaattgcttttcttgtccaggactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaaaaaaaaaa

SEQ ID NO: 332962 - DNA, 1250 bp, Homo sapiens
taatacaatgtaagtgctatgtaaatagttgttatactttattgtttagggaatagtggaaagaaagaatagtctatacatgttcagtatagttgcaatttttttctgaatattttcagtccatggttggttgaatccgtgatgcagaaccaaccagatatggaggattgactatatatgtaaaagattgagattaaccttgaattgtggagggacagaggtttgtctgttaccaacaggaaagaggataataggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaaaaaaaaaa

SEQ ID NO: 332963 - DNA, 1318 bp, Homo sapiens
tgctacttaaggcgtcgtggcctcccctgccccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaactgtaagtataagatatttacatttatagatctcgtctattcacgttgacacttcagacgtggtgcgcctgtactgtaccagctactcaagaggctgaggcaagagagaggatcttgtaagtccaggagtttgaggcagcggtgagctataatcatgccactgaactgtagcctgggagacaaagctacacactgtattttaacaacaacaacaaaaaagataattctatatttatggatttgggtagacataggaaactgaaattctgatttgtgaaagtcttctaattttggggtttgagaaagctttcattctctaattgttggatgtttacctcttgcaacacttgactttagattttgggttttgggggttttattttttgtttttggtgcggtaataagtgatacaagtgatcatatggagatgttttactgtgtcacagaaaacagaagacactgaagtgcacgtggatctctagagcgccgca

SEQ ID NO: 332964 - DNA, 505 bp, Homo sapiens
tcaacaatgtggtttttgccttaattgttactgaaactcagttgtgccttcaagtttatcaaaactagaccaattctacacccttacatacaggatagcaacagtttgtccacatctcaggtatggcagtatcagtttaagccatattgttcatttatctcagcatgtatatgactgtttagaaattgtgtttacataagatccctctgagccattttagtgcctgtggtaattttggttcttccattggttaggaacgggattttccaacagaaaccattaaatttggtcctgaacgcatgtatattgattgctgggtaaaaaaacacacctatgacacctttaaggaggttcttggatcagggatgcagtaccacttgcaggtaagtgtcatcctttctacatatttgcttttaaagtagggagcagtcttgaatatagctcacttaattggcttttgaaattaattaggtatccagagtgcttccacatgttagaaaacagt

SEQ ID NO: 332965 - DNA, 743 bp, Homo sapiens
ggctcactgcaacctctgcctctcgggttcaaacgattctcctgcctcagcctcccgagtagctgggactacaggcatgtgccaccatgcctggctaattttttgtatttttagtagagacgggatttcaccgtgttagccaggatggtctcaatctcctgacctcgtgattcgcccacctcggcctcccagagtgctgggattacaggtgtgagccaccttgcatggcccctgttaactctttgtttttctccttcattctttgtgtgtgttttataaacatttaaatgtttatagggtcaaattagttcatttcttttctttgtgacttttaccctttttctgttttgtaagaatatcttaagtcttactgatgcacgtttttcctttttttcattttagcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaa

SEQ ID NO: 332966 - DNA, 572 bp, Homo sapiens
  misc_feature (43)..(43): n is a, c, g, or t
tgttcatattttactactctcatataattaaaccaaacgaccnccttatgggcacaatttccaacgttaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagta

SEQ ID NO: 332967 - DNA, 2299 bp, Homo sapiens
tgctacttaaggcgtcgtggcctcccctgccccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaaaaaaaaaa

SEQ ID NO: 332968 - DNA, 1037 bp, Homo sapiens
  misc_feature (1)..(1): n is a, c, g, or t
  misc_feature (8)..(8): n is a, c, g, or t
ncctaagngtaacgtgactctctccttaaccaccgctacaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaaaaaaaaaa

SEQ ID NO: 332969 - DNA, 1037 bp, Homo sapiens
  misc_feature (33)..(35): n is a, c, g, or t
  misc_feature (37)..(38): n is a, c, g, or t
gttttaagtgccatctatcatttgcgagaaggnnncnncgtttgaggcaatatttccacagtaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaaaaaaaaaa

SEQ ID NO: 332970 - DNA, 431 bp, Homo sapiens
ttcctgggttactaagtccagatcatggaatattccactctgggacagtaaaagagggtcatgttctcagcctccccagcaccaaagcagctaaaaacagggatcacaggcccccagtgtttccaccactcctgagctgcttggaagcttcctctcagggtgtgtctgtggaaagcctagggggaccagtatgacaccgtttctcaggtatctcaaatgtccccacagtcgcctggaagagaatcatcatctcaagccagtaagcccttgcaagaaccagaatttgagggaagaagaaacattggtggagactgccttggttactatgataaatggccagtaacctttaacatcttctaaagccaaagtcacacagaaaaaagtctgccctaccagactcaaagaaatgttaaaagaaatcttagtgtcag

SEQ ID NO: 332971 - DNA, 828 bp, Homo sapiens
ggtatttgttatgtctcaggaaagctggatgactatctcattctctgatgatggagaagaatactcacaacctgctccccacctcccactgtgaaatgccaatatggtggaaacagaagggagaagaaagaacagcggagacactgatcattcgaaaccaaagaagcagctcatgcataatggagagctatctgcatgcaaattgctaggagtacttcctacttttctgggatattgtatttagccctctgtactctattcagaagagttctgttccccaggccaagaaggggaaatacattgaagacaacattaagtgttggaactaaatgcacaagaatcaggagcatcttaacgccatggcctgaacatgataggtactgaagaactatggattaattatttttgattgattgattgattgaaaatgtgtcactataaaaaagcaaatgtgaagcttacagagggatagtggtgcagttaaatgctaaagttaaatctccttttctggcagctgcagaaagattcctattctgcctcctatacttgctctgaggatatttaaattgtagagctctaagtggctgccctcaatttgcttcaaagataataacgtcaccttacagtttataaagcaccttgttacatccctttggagacctacagcaatcccgtatgaatctggggattatttattctttttttcaaataagaaaactgaagcacagaggaaggagttacacattaaaagccagggaacttgtacattagttaaggtaatgctagcagctataacaaataaatgcccaaatctcagaacttaataca

SEQ ID NO: 332972 - DNA, 541 bp, Homo sapiens
gaatgatccagtagagtgagaagaattgatgatgcaggagaaagttgtgaattcctggagcactgtttgaggaggcgagagtgggtgggatttgtgtgtagctgaagagtttggcctttgctgaaagcatggagagaaggagaatatagggacacagtggagatggggagataaggtggtgggacttgatgaacatgttcttgtgattgcatctatctttttcagtaaaatagaaagcaaggccatccactgagagtacagatggtggaggaggcatcgagtgtttgagggagaagaaggtgtgaagtagtcatcccaagagagactggacttaacagatagggttgtccaagtgaggccagtcagcatggtagtgtgtctccctctggcgacattcagttgcgtaggtgcagactggttggagaacaggatttaacctcttggccttttgctaaatgagcacagtaaagcaagaaaaggaagggacaatgaaggaagaaaaggaatacagtgattatagggttcagacctagcgatgggg

SEQ ID NO: 332973 - DNA, 138 bp, Homo sapiens
acggagctgagagagatacagtgaacaaagagtggttaactacagtgggggaaggaaaagtttgactttgcctgtggctaaaagggaaattcacaatggccatgatttatgggctgaattactcaggatcctccttag

SEQ ID NO: 332974 - DNA, 291 bp, Homo sapiens
ctctagccaatcagatcatcaagcctattaaaactaagcctaaaataaggacaaacaagctctgagtgaaggctgaataggtattttctaccattgcagtttgataaaatcatttcatgcattatccgtttctttctgatgagatatttctattacccaactgaccatgccacccatttaagaagataatttaaagaaatgttttaccaacaaaatttcccactcttctctcattctcttctaaaataaacaaaacaggccaggcatggtggcttgcgcctgtaatcccag

SEQ ID NO: 332975 - DNA, 2800 bp, Homo sapiens
cgcgatgtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggtgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcgacctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaacagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgcctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaacgctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccgtccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcgcagtggcgtgtgcctgtagtcccagctactcgggaggctgaggcaggaggatcgcttgagcccaagagttcatatctagcctggtcaacatagcaagacccctgtctctatttttttaaataaataaactacatgtgaaaaa

SEQ ID NO: 332976 - DNA, 3075 bp, Homo sapiens
cgcgatgtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggtgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcgacctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaacagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgcctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaacgctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccgtccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcgcagtggcgtgtgcctgtagtcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgtcttcactctgtttctaagaactctggtttttatacttgagactctgtagtcactgtggaaagaggtgtgactgataaagaactgcctttaaata

SEQ ID NO: 332977 - DNA, 1064 bp, Homo sapiens
tagctgggattgcaggcatacaccaccatgcccggctaattgtttgtatttttttagtagagatgggggtttcaccatgttggccaggctggtctcgaactcctcaccttgtgatccacccacctcggcatcccaaagtgctgggtgattacaggagtgagccatggcacctgacctataagccctctttctaattgtcagcagagtcctttctgtaaattcctttccgttttttgagccttaacacttatgtagtctgagcaaaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtctcaggggagaagaagggaagctagtaagcaacttatagggggcagtgtaagaaatgtcacatgttacatcactcacacagagaagcagaatttatcaattttcaaagggaaaatgtctctgtctactgacaaggttttaatttttgctttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgtcttcactctgtttctaagaactctggtttttatacttgagactctgtagtcactgtggaaagaggtgtgactgataaagaactgcctttaaata

SEQ ID NO: 332978 - DNA, 436 bp, Homo sapiens
gtccaacgaattaaggcaagatcttcgatgagcccttggtggttagagttggttgttgtactgaagcaggtactcttgtttcagctgggctcttatggccaaccgttcagcttgcatctgccagccttccagagatatgtcatatttggctgagtcgagggtcaagggcagagtggccaggtgcgatggagtaaacttggggaatgacattttggtgacccagcacacaactgcctgaaattccattttcatgtgacacttttgtatctgtaaccatcaggtctgttccctatgttttctattccttaacttggctaccattataccatcacatctctttccttttctagtgactccccattagactagctcctatctcataacctccttttgtaatttaatggcccaaagattagcaaattccagaaattcctaa

SEQ ID NO: 332979 - DNA, 369 bp, Homo sapiens
tttatgttgtttcatatgctagctaggacttgttgttaacagactttttatttttgccagtctggagttgtgtattactcatgaacagcagtgttcactgggctatttgcatcagtacacttgcaaaaatttaaaagggtttaactgtcttcaaggggcttatgctattcttgtatagacaagaagtactggaaaaaagataaataacagggaagtgctagtgaatgttatagacaaggaactatgttttccttgaattttttataattttactgagtttctctagctttttactgtgacaaatttcaaacaaatagaaaagtttaaagaagaatatagtataattgcagtatactcttcacctaagtt

SEQ ID NO: 332980 - DNA, 1094 bp, Homo sapiens
aactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttcagctt

SEQ ID NO: 332981 - DNA, 575 bp, Homo sapiens
tcttgttctaattaaatcatacaaacataaaaaagttcatgataaatgaaaaacagattattagactacacataggattatctatctatatataaacaaaactcaaaatacctggttttcgttttgtttttgtttttcctgagacaaggtcttgctctgtcaccaaggctggagtgcagtagtgcggtcatggctcactgcagccttgacctcctgggctcaagcaatcctcccacctcagtttcctgaatagctgggaccacaggcaatgaaagtttttatattatcattaataataattatctctgagtagtgatcagactatgagtggtttttttattttttttcttactgggaatttttcatctgttctattttttaaaaaacaaaatctgtattgagatttaattcacataccatacaattagcccttgtaaagtgtatgattcagtggtttttagcatatccaaagttgtgcaaccatcacctcaatcaattttagaacatttttatcactccaaaaagaaacgctgttctcattagcagtcattacccatttctccccaaccctccca

SEQ ID NO: 332982 - DNA, 726 bp, Homo sapiens
gtgatgtctagagcagtgatttccaaatgggagcaaaaggatccaagggaatgctcagaaatatgcaatggggtacagaaagaagacattatttaagatttggtttacttatctcaaaaagaagtgactaaaagttcaatgggagaaatgatagaagctaattgtgataaaacagataaagtacatggcacaatgagtgtgaacccctggagttttacaatcatttgaaattcaaaggcaaatgctgagagcacaccatcatgagaattggcaccaatgaaaaagtttgtcaaaatcactctggcactaaaccactgaatgttttcaacacaaatggaaagctgacatcatttatagacaactcatggaccaacacaaaggaaaaaatgtcagatccagtgaatttcttttcttgtaattactgtatgatttcaacattggcgtctgtaagaaatactattttcctctgaagtgttttctgtagcattattttgtttaccatgggaggtttgtcttctcccattttccttagaagttgaacacacattttcaaagcctgctagtgattttgaatttcaaaagcgattacaagcatgattcatgcaatatgactcatccctctcaaatgctctaattgtataaactatatccttcaaagcgtcttatggacacattaaatattagtaaacacattttcaagtgccaaaaggtatggttccttcacac

SEQ ID NO: 332983 - DNA, 501 bp, Homo sapiens
gggtggggaaaactgatcatctgattttgtgactccatcaaaaggaaaggtcagactttcttacgaaggttaaaaaacaaaaccaagaatcctttaaaatggttcctttttgcatttctgacttgactctgtaatttgattgtagtcaagaggagatgttgtctgcatagaattcctgagcaagtgggaatcttcccagggaaggaagctctggggtaggaaagggatgacaatccgaggagacggggggcagggatggattcttggctgggtctctccttgcacaggttacttacctctcagaactccatctagaaaatggggatgctgatagaaaattatttcacaagcgttatctctttggcctcacctcaaccaggagcctggattagcttctaacatttccctgacagagccatggccttccttgggggaagttccttaaacaactgtcttcccatcataaattagcgttcacataattcaggttccctgtccctg

SEQ ID NO: 332984 - DNA, 287 bp, Homo sapiens
catagactatccccagtatcctaaggggatgtcctaacttaagtcttattctgtattaattgcagggcccatgggagggtgggagtcctggcttgagctacagctatgctcagatgaaccattcaggaggcaggctggccttccttaggcagtacttgcatagccaccttagacctgtttctacactggacagattgggggtagacgtgctgtttactggtttggctatttgtgaggcaaagttaagttatgactgagtatggcctttagagtctggcaagggccgg

SEQ ID NO: 332985 - DNA, 281 bp, Homo sapiens
acactccaatcatcaggcagaattatatttttccctcaataaggtctctcattattaaggagattataaaaatacatagggtcagttctggctagaaagtttaatctctattagcacctttcaaaagaacactcgctcaatgacggacacttatatcatcaaaattattaaagcgatataatgtctagaagacaatgtaaaaaatttggtctctgccactaaccaactcttgaagaaggctggctagatctgagagatttagttatctgaccacttagcac

SEQ ID NO: 332986 - DNA, 175 bp, Homo sapiens
cttctgtgcctctacactgttgacggcgcgggataattccttatggttgcatagggcactcctgtgcactgcgggaagtttaacagtatcactggtctggactccactagatgccagtgaccccgtcttccacagcctacccgtcttccacagcctacccgtcttccacagccta

SEQ ID NO: 332987 - DNA, 290 bp, Homo sapiens
acagtaagtagtcaaggaacactggtttaatgaacagaggtggaggagatggaagcatcaggctttgggtgctccgcagagctgggatgcaaacgcagctatctggctcaagagcctgaattgcggtgctttgaggcaggacagtaaaggcaccatcacaccagttgaaaacctttgaccggcaattccttccacggacaactgctgacaagtgaccagtggggatggacaccaccatggcatttgcagagttgaaaatggaaaatgacatctgtgtcctctactaggga

SEQ ID NO: 332988 - DNA, 170 bp, Homo sapiens
ttttttgtagagatgaggtctcactatgttgcctaggctggtctcaaactcctgggctcaagcgattccccccatcttggcattccaaaacgctgggattaccagcatgagtcatcacacctggtctgttttcttaacaaaaaagttttattcaaacacagccatgtatg

SEQ ID NO: 332989 - DNA, 148 bp, Homo sapiens
cacacaaacaaacaaacagacaaaaaagaaccattcctgagagcatctggaattaaatgaatagctatggtgaagtctggctgctggtactgcgcttttttttaaacttgctgatttttgctgccatgaaaaatcagcatcatcacaa

SEQ ID NO: 332990 - DNA, 195 bp, Homo sapiens
gggagtctgttttattcactgaagcaggctcaagccatagaccgtgcctggcacatagcagatgctcaaaaaatatttgccgaatgaatgagggagtttgtttacaggacagatgctggaatgagacccaggacagtgttgctgggcctttgacttgggcttgggcctactgaaacccatgcatcttttctccca

SEQ ID NO: 332991 - DNA, 325 bp, Homo sapiens
gatgaaaaatattaaacctatttatataggtacgtctccttggaacattggccaagtagaatagttttcttttggtgcttcttccacatttagccctagttattcagattggatagatagtatttgtagccattttttaaatgactgtgtagattaaaaaaatatgtgtgtaagcttggtgtcatggcttacgcctgtaattctagcattttgggaagctgaggcaggaggatcagttgaggccgggagttcaagaccagcctgggcaacatagcaagactgtgtgtcaattaaaaacaaaaaaaaaatttttagaaaaaaaaaa

SEQ ID NO: 332992 - DNA, 343 bp, Homo sapiens
tgccatgcggggcttgagaaaagcggttatccaggaactcccaggtcatgtaagaataaaaatctcccttcctcccccttgcgtttgccaattgggcaaaccccttccgaactgctcatttccgagcgtggacagttgtggctatttctgcttcctcctccggatggcccctcctccaagcagccacccacaggtcccccagggcagaagtggcagcccctccctggggacctcagctgaccttgtactcagcacagtatctctgctgaacttctatttataatctacttaacttcactgttttaaattttttggtagagatggagtctccctatgttgccct

SEQ ID NO: 332993 - DNA, 610 bp, Homo sapiens
cctcctcccaagtgtgaacacagactcttttccctaatcgccaccgcagccctgggaatctgatgtaaatgtaacaggaaaccaaggggaagtgccagctgagtaacgtaactgctcctgcttgggacaatcctcagtacagggtgacattgggttgtgaatgggaacaaaaacttcatcgtcaggtaggtctgaattctgcccctactagttgtgttacactgaaaaccccatctacgctgtctgagctggctccctccatctgtaagacgaggaaaatgatagatagtatctatcccatacgaaaactcatacatgaatgttcaaaaagtggaaacatcccaaatgcccatcagctgatgaatggataaaaaagatgtggctgtatttatcaatggaatattacttggcagaaaaaggaatgcagtactgatatacgccacagcatcaaggatcctctaagtgaaagaagctagtcacaaaagaccatacatcacatgactccagccaaatgaagtgtccagaatgggaaatctatagagaaagaaaggagataagtggctgcctaggggagggggtggaggtgagtaggaaggaagtgggcagtgac

SEQ ID NO: 332994 - DNA, 551 bp, Homo sapiens
tcagaacggaacagaacaggacagggattttcacagtgcttttccatacaatgtctggaatctatagataacacaagcagttaagtcaggggttgatttttagctaccaggcccagggcatggcactgggctggctggctgtggatttcatttctgctttttagtttttacttcttttttctttggaggcagaaattgggcataagacaatatgagaggtggtctcctcccttcacagaaccatgaaaatgccatttccttcctagccaggaatctgcatgtataagtcctctaaggaattctgacccaagtggtccttggatttacttctggtaatgccttagggagtatattctgcgctgactggtggattgactgatgaactcacttccttcattcagcaagcatttatttacctctactctgtactgggcgccgaagacagagcagtgaacaaaacagaggcaagtccctctcctcatggagcttacgtttctgtcttaggcagacaatgaatggattcacaaagaatatgtgcaatgtggtgttgg

SEQ ID NO: 332995 - DNA, 387 bp, Homo sapiens
atgttgacccctcatgaacaccttgcactccagtatatttctaagtgcttctgagagcccggcctgcaacaccacttctcccctctgcctccagcctagagatgggaatggcttcctgctggtgctaatctctaggtggcctcaccatgtcccatttggacactctgctcttgcatcatccatgtaatcaattaactgcattaaatccccatctctttaaataaagtaggttctgacacagccaacattatactgaatggggaaaagttgaaagcgttcctcctgagaactggaacaagacaaggatgttcactttcaccacttctattcaacatagtactggaagtcctagccagagcaatcagacaagagaaggcaataaaggac

SEQ ID NO: 332996 - DNA, 225 bp, Homo sapiens
tcagggagcacagagaggaacctggaacaatgacaatgtgatcaatgcctcaggaataggcatttcatgcttatgttagagctaggttctcatatctttaagaaattagaataaacatggggtatatatcacaggcatctgaagaaggaagtcaacaacttgcccagtatcacacttagccaggacaagtatctgtctggcttgctaatccagtttctttccatt

SEQ ID NO: 332997 - DNA, 133 bp, Homo sapiens
cggctccgaccccagctgcaggcgaccctccctccccagccagagccctgggcccgcctcctccccgggggcctagggaggtggtacccaggtgggggggcatgtaggtgacctggcggcctggctcagttca

SEQ ID NO: 332998 - DNA, 800 bp, Homo sapiens
taagaagagaagatcaagtcatcactgggtaagtaaactacagaaagcagctaccacctctagggctgaggggacaaagttaagacattggaaccatcaaagtttataaagcttgcaggagggggtctcatggtgctgatactgaggcctctgagaagggagtactgcttagctagtactggagtccctgtgctctgagggcctgggacctgttggcctggagagagtatgccagagggctgatgctgatgtctccaggacaggcatgatgagactagttctgcaagtgttaaaactggattcaggggctgttttaggaagaaactcttgctgctggagtgaagaagttctactagagtcacactcccaggagtctcaagtcataaggaagtccatgtggagcaagcagacatgtccgagtcccttcaccagcttggcagtttccctccagcgcaccttactggcagagccaacatgcagccagcaggcaaagcaggaatgtttgcacagtctagctctggcttcactaaccggagatagaggtggttctgaagctgagacaacttaaatggcacagatcacccctccagctactcagcatccacatacacccttccacacctttcaacttttcctccgacagccacacaagtgtttccatctaaaaaggtgcaactgtctttcattcagagaaagatgttctcaccctctccccaaactgggaagctgcaaagaccccataggcatcacattcatttctggaaaacggttactgtctttgggctacattaaccacccct

SEQ ID NO: 332999 - DNA, 716 bp, Homo sapiens
cctgacattcccccacccctaccctctttcctttccaatactctctgtatatctgtattaatgttcccaccacactgtaggaatatctgtttgcatggctgtttcttcccctacactatgggctctttgaggatagagaccatatctagcatttctctgtaactaatgcccagcacagtaccttggtgtcaaaccgaatacgcctttgttgaataaatgtatgagtcaatgaatgaggttgcagagttatcaagtggaggagggattagaacccaggtatcttgagcccaagcaatttgaaggtgtttaagctaattcttttgtatgtttttctggctgtttatgtacttttgaagtctttatctttctgtgttaaaatatgtctatcgttattgcattttacagcatcaaaaattaagaatacttacattcttctacaaattgatgcttcaaaatagaaaatttggaatttcagaagctccagtacagtaactaatctgaaattattgatgcattttctttcgtcagggaataactttgaaagattcaaatgatttcaaaatccaactttctaacgtctgggagagaattcctcaaacacatttagcagtcaaaacaattctatagagtataaaagatgaagcatggcacttcgaagtaaaggttacagtttctataaatgagaaaaggccgaatatttgctagcaaaatatttt

SEQ ID NO: 333000 - DNA, 158 bp, Homo sapiens
cacacagatcggaattctgggaccattatttattagttaagagatctggaagaagttatacaatgcctcttgaattagtttgcttacctatacaatgggaataacagtatataactaacagggttgtaagcattaaaggatatattatattttcaaat

SEQ ID NO: 333001 - DNA, 2278 bp, Homo sapiens
aaagagcaactattttgactgcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtcttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaaaaaaaaaaaaaaaa

SEQ ID NO: 333002 - DNA, 1468 bp, Homo sapiens
ctccattctcggacgggtgctttcaggtacaagttagagttccagtttattcttgagaggctgaaaaaattagccttatgccattaacctgagaatacgtgttcttgaccaggcatcttcagggttttctgaagtagtcagattgtgtattcttttacgtatttgcctatcagaccttcacttaggtgtattcacttaggtgtatttctctctcgtgttcttttccagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtcttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaaaaaaaaaaaaaaaa

SEQ ID NO: 333003 - DNA, 1878 bp, Homo sapiens
aaagagcaactattttgactgcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtcttgtatatatctgtataatgttgagattacttacgaaatatgtctgagtgacacttttcacccttgtacagccaaaatatgacatttggcaggtgcaaacaatcccaactcttggaaccctaaacacaataagaccacctgggaggagggacaaaacagatgttccaaccctcaacgtgcgaagcgcccgagtgaccacccataggagggagcgtacaacgagcgaacaacggatcgacgaaagcggacaaacgaggtagtgagccaagagacgccgacgcgaccagcgccgacagaaccccagcgcagaacaagcaagagcaagagaaaaagagatagaaagagcacgcca

SEQ ID NO: 333004 - DNA, 2062 bp, Homo sapiens
aaagagcaactattttgactgcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttagaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtcttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaaaaaaaaaaaaaaaa

SEQ ID NO: 333005 - DNA, 279 bp, Homo sapiens
tttttgtaattttagtacagacagggtttcaccatgttggccaggctggtctcgaactcctgacctcaggtgatccacccatctcggcctcccaaagtgctgggattacaggtgtgagccaccacgcccagagaatcctaggttttcaatagaggagttgaaatcatgtacctagttagataattagttttttttttttctaaagaaagactagtttatttcaagaggtatatactaagatctttccagcatagggcttctctgattctgtgtttaatc

SEQ ID NO: 333006 - DNA, 329 bp, Homo sapiens
ctgctgtgtgctgtgcctcgggttcctcccgcgtctgcgtgcctcaggcttgcgctgtcgctggggcagtgaacgtgctggggaataacggaccttggtgtcccctccgccttgtgtgcccatgcagctccgcgcgctcgctgtcaatagtaacggtcccctgggggtagatatcggacgtggggaggctggagctgtgaataggaggctgggaaagtgttggaggagggagcacttcatggatccttaggattccaactggattcgcgtttggctccgttacataccctgtactttactgttctcgattcataaacatatccagacct

SEQ ID NO: 333007 - DNA, 500 bp, Homo sapiens
acccttgccctgacaaactgggtcagctctgagggatggggccccaaggttccattgaacagtttggttggagagcctggagcagataaaaagatacagcgctagctaatcaggagaccttagccctcgtcctggttttgccgttaactcttaattaaccttggcaagctactttctttcttcagcctgcctacatttccccatctgtaaaatgggagataatatgaagtcctttatggcacagcacacatcctgccttgtgagggggcaggggatccacgctgctttgaacaaaaattcccactaagtattccccaaattcagttgctaattggcaaaagaaaaaaaaatagcactctgattaaatataaggatacaagttctcctccaaaagtaaaaggctcctcaaacaagggacttaaagggaggaagaagggaaatggattacaggaaactagaaaattctcaagtataaagaaaataaggagtcaattattaaa

SEQ ID NO: 333008 - DNA, 418 bp, Homo sapiens
tccatttcagggttaacaaagccagactggagatgtgtctagcaagcctccctagggtaagaatctcctattggtgtatccaagctatggcccatggaaactcttcacttttgatagttcagaagaacaaatgtttaacagaagtgaacctctttatcactctgaagtttctgcttctcatcttgacgtgacctggtgcctggtaggaggacttattgtgagctatttgcaggactaatattcaggttcactcagattcagtagtactggtttttgatatattacaatacttatgtactaggtggcacgtggtataagctacagctgtggccctggacacagctgctcaacagaccaagagagcagaagcaggggcatgtgtagcatccatggaaggctccaggggagctaagcactg

SEQ ID NO: 333009 - DNA, 397 bp, Homo sapiens
gtgcaggctgaagaattcaaggagaagtgtacaaatgcctgcaaggccctttgaaatgcatctaaaaataatatagattgatgattggagagaaggatgaatacattgatagatacataataaagctaataaaatggtaactgcagactctagccagtgggtacacaggtgttcattgtacaattttttcaactttgatgtatgtttctacatttatataataaaatgtacaataaggaactgtgtcaaataagtcatttcttaaaaaaaaaaacaaaggcaaagctgaaaattatgtagacacaataaaaactcaaacaacagtctgcctcagatcatcgtgctgatcttccaaatttcagcagggatggttggttttcctgcaaacctcgaaaca

SEQ ID NO: 333010 - DNA, 454 bp, Homo sapiens
cacgatgttgtgccacagtgattggaataattggaagatggtcatgcctttggaaagaaatagaaaagctaagaggggcaactagttagggaaagcacatgatttgtttgattctgtatactcctggtatgtatttctttcacttaatggaatgtaagcaaatagaactggaaacaaatgttaagataacatcatcctaataacatctatgagatacatagaaaagccagccagggagactgaatcaggctcacagagggtcgggggaatccagggagagctcagggagaagagaacttccacgatgtagatgatgtaacatttatatcaaagaagccaaggaaaatgagatttgagtcactaagaaggtttttggacaatagaagcttcctgtgcacaggtaaaggtgaagtgggtagaacttgtagagaaggagaaaaagaaagaagataga

SEQ ID NO: 333011 - DNA, 164 bp, Homo sapiens
cagggagatgcagagggcaagggctctttaggctcaagtagtgcgtcgtatgggagttcggaggcaggagaaagagcatgtatattaagggaatggggggaaagtgtataggtgtggaatatgcaagccctttaagagcatataaagagagaaatgggctttgg

SEQ ID NO: 333012 - DNA, 855 bp, Homo sapiens
tggtttcatgtctgtctttcaatagaatgaatgggagggaaatagaaaccatgtccacatgacattagtacctgcatctaggaaggaggacttagtcccaggaaggctggccctcccatctggccaccctgagaggtttcagttcccttctgattcatgtgccaagcttacctgtcagctttcacctcccaagggatgcagcgtcagtgtgttgaagctgcagcatatgaaccaataaagctacctctgagtaacatggaagcaaggtaggaaggcaaaaaccacatcccactgtgatatcatcagccatatttcttccacatggcaagttttattttgtttaatttaacaataaagtcattatattaactcgattcaatagaagcagcagggggatttctcctaatttaatcgtgggctttggggcgtcttgctcagtgttaaaacaataccatataaaaatattaaagggattgtattatattgaaaaaaatatgttagcgtctccaaatgcagcctacctttaatttagaaactagtcagcctacttcttactttatccgaagtgtcatctagtcaagagggccaatctctgcaagcaaatcatgccgctttagggtttaaactccgcaaagtgagcatttcatccatggaggtgatgctccaatttgaagagttattagatacacccagccagggaatataaataacttgagcttaccagtgtcacagaactggttttctgtaagtcacttgaaaatacaaggacatagggccgggcatggtggctcacgcctgtaatcccagcactttgggaagaagaggcgggcagattacgaggtcaggagttcgaga

SEQ ID NO: 333013 - DNA, 347 bp, Homo sapiens
ctctgtgctggagcgcatcccacggcatcttccagaaactccagggagcagcgctgggacgtgactcgcttcctgcaagatgacaatggagcctcaaaacaggccaccagcccgggtgccgcctttgtggccagaaaccgagtgccgcccgctgtgcagggaagggccactctccagcccagcggcgcacccatgggccgaggggcttccagagcccatgcagactgaggcggggaggaggggcacctcctgccttgagaggttcctgttttggaggcactgagctcttctctggggaccagcagccctgggggacaggctcctcaggcataggatagcacagcaca

SEQ ID NO: 333014 - DNA, 1858 bp, Homo sapiens
atagatagatagatagttggagtttggataaaaatctcgagttgagatctgagagaccattctgagggagtgtgtgagtagaagaccaagatttgaaccctggtaaacatggtgcaagaggaagaaaatgaaggagacattctaggtggaaggagaacggtagtattattgggatggtaaagagaagagtttaaagatatttggaatagtgaattgtgtttggcacgaggatttgtgacagccatccttagctctgtcagctgattatcgactggggccgggagtgtgggcagtggagactgtttggaaatgtatggtggtgttggagattgccacagtgattgtaggacactactgccacttactaggctggggctagggatgttgaactttgtccagtgcacaagaccatcccatacaagtccaaaatttaatagcacctctgctgagaaatataatgccagggatctatttcagttctccacactccattggtcaccatgttcattcatgtctgccttctaaacatctcaatctagccctttcttcccccttctcagagccactgccatacttgaggcttccattgtctcctgattggactatttatattgccgtaacttcctaccttgattgtctattgccactctctttgccacctcccttctgtttaccaccagaaccgtgaatctaaaatatttcctcttcattaaaagtgaaagaacattatcacgtcatttcctgtttcattaaaagtgaaacattttttaaaaggaaaaataatagcccttcaaggtctggcgctaagctcattttctcgcagcttcaccatggtatctatcttgtattccagctgcagacctccacattcctcagataagtctttccttttttgtactcctttatatgtcagtgtgttcctccttttgtctgggctgtcatttcccttacccacatagagaactccttcctttcaagaatcaactcctgtgtcacctactttgccagtacgatctgttcctctctctctctcgctccaaaagactaatctgcacactctgttacagcacttgtctaattgtgctgtagcgtttatttacatgtttgtttctcctctagccagtgagcacctctcaagcagaattatcttccttgtttctctggcaccctaaatatttgttgaattaatagtccttctcttcttttgtaattttgctttctgtaatagaagcttaattttaagtatagttatatcagtaatcaaaatgaatcacacactgagaaatcaatgtggatgccctttaagggttctgttattttttttattgccattgagtaaaataagatactctgtgataaagtatattagcattaaagtgttcaaatctgatctttattagtaggcctcaagtgaatccttgctgacatttaaggtttatgacatttccttcacgttcgttcttgactggaaggcataaatggctgacagtaaagagcaattaataattttccaagtaaaacattttcagggacatctgcctttattgctccccagatgagagtacagcctgtttcttatgtgttccaaagatgatttccctatcagctttttggtcagttaaccaaaaaaaaaaaaaaaaaaaaaagaaaagaaaaaagaaaaaaaagttacacttttctgaattctgcaagattgacagaaggggaatttttgagtctactttgttgcttggtaggtgtcatatttgctctttatttgacagttatctagacttaaaaaaaatgaagcaggtttttttttagtgccagtttatattgtttactaagcaagtgctacctctgccatccagtagggtga

SEQ ID NO: 333015 - DNA, 5553 bp, Homo sapiens
  misc_feature (30)..(30): n is a, c, g, or t
  misc_feature (44)..(44): n is a, c, g, or t
aagagaagaggaaggcagcccatatctacnacacagcctctcgncactgctgctccttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaaatttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggtttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtt

SEQ ID NO: 333016 - DNA, 3649 bp, Homo sapiens
ctcattctgaagatgagatcccagttctttgtggattcctcttccttattcatggctttttgcaattgtcaaggaatgactaggtaccaagcaactttaaaaaatgtatatttaagcattgaaataatatcaaatgtgatttctctgcttgtggttatattgattatattatccttttaataatattggcattatattcttggtcgtaaaatgtcaaggtcttatttattcagtatatttatgttctgtattttcatatatattatctattttcagccatgcattatatataatgtcagtaatagtatttcattagcattcattataaaaaaactcgtttttaatatttgactaattcaagtcacagtacttttgagatagctgaaaaggaaaataaatgtgttttaatgtgctactacttatacttgaattattttatgctcatatttgtttttagaaataaattgtgccagctattttgaaatcttagaaattgttcatattaatattgtcatattttcttttctataagaaatataatttgatatataaatatacttccccacgcatgtttaacgtataagatcaaatgttcaaagcattaaacattaattatcttggaattttattatgtgtataatatctactaatacctctatgtaaaccagtggttcttaatctttgagatcacagacccccctctgtgattaaaaaaaaactgacaaaaaatattaactgccctgaaaaaagttttagaactacgttttcaaaattttctattttatgttaggtggttcagagacccaccgcaaagtgctaccagtgacccctatttcaaatcccctgtaatgttaatgtagttattttatattagcatatgtttcttaattaaagtgtgtgataattgctggtagatattttaatatttctaagttactacagaacaaaatgtattttaccagaagaccacttggtaagcatttattacatgtttttcttttaaggcaacagtggaagttaacttacaaacatgctgtgaatatttttctagcttcatgtaccaatatgtagaattgtgcttttatttctaattaattttttcctaacactattattataattagctaatatgcagtattgtaaatactacttaaatgcataacttcccaaatctagagcctggtttccttttcagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggtttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtt

SEQ ID NO: 333017 - DNA, 2670 bp, Homo sapiens
gcgatgtcctaaccactgaggatccccagtgcccccagcccttggagggggcctggccggtgactctgggagatgctcaggccctgaagcccctcaagttcggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggtttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtt

SEQ ID NO: 333018 - DNA, 6038 bp, Homo sapiens
  misc_feature (30)..(30): n is a, c, g, or t
  misc_feature (44)..(44): n is a, c, g, or t
aagagaagaggaaggcagcccatatctacnacacagcctctcgncactgctgctccttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaaatttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggtttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgttaaaaaaaaaaaaaaaaaaaaaaaaaaaaaaaaaaaaaaaaaaaaaaaaaaaaaaaaaaaaaaaaaaaaaaaaaaaaaaaaaaaaaacaagcaacgaaaaaacaaaaaaaaacgaaaaaccaaaaggacgggcgcgatgaagagaacacaacaatacacgaggagcaggaacactcgtcagcgagacgcctataaagaagaaggggagggacgtgcagacaaaacaacagaaaatggaaaagacaggagaagaccctacgacgacaatccactgcgtcgcacaaacaactaactaacgtagaaagcgcagctaagagcggacacaaccaaccgcccgaaggtgaacatcacgaggccgaaaacgaacagcaagcaatgtaccggtgcaacgaaaaaaaaactagacactgagggagaacccacaagcaatagcatgtcaaaaagaaatagagactagaaaaaaaacacaaacaacggaaaaaaacc

SEQ ID NO: 333019 - DNA, 2323 bp, Homo sapiens
tcgggtgcaagggtcttatttttatatgacacatctggactgtatccttggtccttagctgttggtcctgtttggagagcttcagcccttgctttcatacctttcccttcaaccaaatgagcctatacttgtctttaaaattcataataagtattttactttacagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggtttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtt

SEQ ID NO: 333020 - DNA, 3940 bp, Homo sapiens
  misc_feature (30)..(30): n is a, c, g, or t
  misc_feature (44)..(44): n is a, c, g, or t
aagagaagaggaaggcagcccatatctacnacacagcctctcgncactgctgctccttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaaatttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggttttttttcaacagagcaagactgtctctcaaaaaaaaaaa

SEQ ID NO: 333021 - DNA, 779 bp, Homo sapiens
  misc_feature (9)..(9): n is a, c, g, or t
cggtgtctngaggatccccgaactgattgagcgccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtt

SEQ ID NO: 333022 - DNA, 4271 bp, Homo sapiens
  misc_feature (30)..(30): n is a, c, g, or t
  misc_feature (44)..(44): n is a, c, g, or t
aagagaagaggaaggcagcccatatctacnacacagcctctcgncactgctgctccttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaaatttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagcaagaactggaaatacaggaataaatgtttcctaaactactacttgatttcatccttaaaaatcaaaacaaactgtggtgttaattgactgtgtgtgaattccattgtcaattttaatgaaattttctttaaaactctcacctccatctgaacttttcatagtagtgggattgactacaaataaaaacttgtggtattcctggtaatactgtccagaaataagagattagtataaaatattaaaggatgcagagaatcagctctgttctgcgtttaatagatgaaagcctttattgagctcagaagcagatactgttactatcatttggaaaattttatcttatggtgttcatgtgcatttcaggtaaaattgaaaaacaggacaattattatgtccaattaatatgtttatgtttgtgagtcttgatgatggaattacatagctttctgtttcacaaatggctctaaatttgcttaagttacgggactattacctggagcatctgctttaataattgaattgtcagttgctctgagcctgcccttagacctcaagtaataaatagttggcacatgaattttgaggatatgtttcctcttccctctttttcctatttaaccccttggtactgttgctaaataaatgatagccattttataattatgttatatacattttcagcctttagcatttctgcttttcaaaaattgaatctccttgttggttatgcttatttcataattattagttttaattaatgtagatagaagttgaacatgtaattaggcaaattgctgtgtggcacttgaatacatagatttctttattttcaaaaaccaaccttttgcttttaaatccttagagagggtttattatcttagagaaaaaataattataatcattatttttgaaattagtatcctcttaattctcaacataagttatgtttcaatttcttttttttgtaataaatgatggaaatgtttaacaatgtcttatctagcaactttcatgcttctcctcagaaatgaagccaaagtataaacttagatttaatgtgttgtatatttgaagagaatgaaactattaacatataattgttcagttggattatgtattttaaggattgcagttatcaaaataataaattgaatgttttatgtttaaccac

SEQ ID NO: 333023 - DNA, 672 bp, Homo sapiens
aatctgtttacctaatgaattccattgctatgattccacttggatcaattccgagtgcattgaagcttcagaaagggcaatattctgtttccccgagcttaaaaaccatgagtttattagatattttagggtacttgtttttaggtagagttgtgttttattaaccacagcaatttcgtaggacttctgtgctaatcccttcctcagtaaactacaggtttgggtttcttatctccaagatattctgattttctctctgttcattgtgttttagtgggtcaccagaagaaatggtcttgctgccaagacaggctcgactttttgcctgggcagatcctactggtaccagaaaacttacatggacatatgcagcaaatgttggggaacatgatctgttaaaggtatcttttgatgtgaatgagtgctatatgagttacctgacagtgaaggaagtagagaagctatcttcactgactccttgtcctaattgaactaaaagtgaattggaagtatttccagaataagtagcttttggactttagatggcaaatactgtagttcaaaccagtatattactttagctctatcaaagtaatttatttacaatttaaaaaatagacctgctttatcttgcctatgtaaagcacctttttaattaatttacctatttta

SEQ ID NO: 333024 - DNA, 433 bp, Homo sapiens
tccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccaggtatgcaagaaggaaaataagacatcctaaacctttaaaaggcattaagttcataatagccgatttgaagaaagtaaaaagatacctggtttgactttggtatgctgtatatttattcagtaaagcttactgaataattctttgaactgttagttgaaaagccccgaggatagaaagatgactaagatattgtctttgtcttcacaatactcattgtcagttggtggggga

SEQ ID NO: 333025 - DNA, 379 bp, Homo sapiens
acttaaaaaaaatgaagcaggtttttttttagtgccagtttatattgtttactaagcaagtgctacctctgccatccagtagggtgaaatattggcaagaataaactgtcttcatcatttactgtaagtttttgttttcttttgcaaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggtaagaaaacatgtcacacctttagagctaagagttcattgcttttagactgttttgcagttaactacacaaaatatttgaaggattagtgtcgttattacta

SEQ ID NO: 333026 - DNA, 1962 bp, Homo sapiens
  misc_feature (30)..(30): n is a, c, g, or t
  misc_feature (44)..(44): n is a, c, g, or t
aagagaagaggaaggcagcccatatctacnacacagcctctcgncactgctgctccttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaaatttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggtatcttttgatgtgaatgagtgctatatgagttacctgacagtgaaggaagtagagaagctatcttcactgactccttgtcctaattgaactaaaagtgaattggaagtatttccagaataagtagcttttggactttagatggcaaatactgtagttcaaaccagtatattactttagctctatcaaagtaatttatttacaatttaaaaaatagacctgctttatcttgcctatgtaaagcacctttttaattaatttacctattttaaaaggaaggaattgtaagactaagttaaaaacaactttattttgaacatacctatgccacttttggctatgagtttttaaagcttgttttcctaagcacagctatgtattttgttaattaatgaagtctgatagtatgcaaattatcgcatgtaagaaatttagtgaaatatttatcgaaacaatatttaggtagctgagttgattaaatatgttattttttagactcttagcctctgaaagggcccaaagaattcatataccatcctcccatctgatataggaattgctcctgcattagtaatatatcatccagtttctgtatgaataaaatccatgatgaaagagttt

SEQ ID NO: 333027 - DNA, 4441 bp, Homo sapiens
  misc_feature (30)..(30): n is a, c, g, or t
  misc_feature (44)..(44): n is a, c, g, or t
aagagaagaggaaggcagcccatatctacnacacagcctctcgncactgctgctccttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaaatttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggttttttttgaaacagagcaagacactgtctctctctctctctccatatatatatgtgtgtggtgtgtatatatatatatatatggtggtggtggtggtggtggtggtgtatacatatatacagcatattatacacacacatcatgacatatacgatggtgtatatatataccatcccatatatagtggtgggatatatatatatatatatagggataatgggtatatatatggggatggtgtgagtggacccaggcaagtatatgaaaacataaaacgtccctgatgcataatgaccaaagagacatcgcgtgaacgtggcagcggcaacatatgcggaggggcaccgcagagtaaaacactcttacaaaggcaaggacacaaaagaagccactctgcatcgcagaaaaaagggtccccccagcggggagactagggtaactcaagacacgaattatacaaaccacgaatccaaaccaaggcaccaattcaaacgaaacactaccggaaaaatacaacacactgcataagaggtcatcaacc

SEQ ID NO: 333028 - DNA, 1020 bp, Homo sapiens
  misc_feature (30)..(30): n is a, c, g, or t
  misc_feature (44)..(44): n is a, c, g, or t
aagagaagaggaaggcagcccatatctacnacacagcctctcgncactgctgctccttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagaggtagcatttttctttgttacaactgattcctaaaatatacaaataaatattgacatctaaataagaatt

SEQ ID NO: 333029 - DNA, 355 bp, Homo sapiens
cagtccattttctacacgaaagaaactcactatattaattactgcaatacattacattttacctttcttacaaaggtaaaagtaagttaggttgtatcttaatggacaaacatatcctgtagaagagagaaactttttcctctgtgctattttgtacttgtaatttaatgacgtgaaatatgtaaaatctcaacctgcccatccttgcattgtagctgagtactcacattccatggggtggtcttgtccttgactcttggaggggcaagttcaagcggctaccatgcacagaaggggaagatgatgaaaggagaactccgtctcctagggaagaatcagtcctactgcagttgag

SEQ ID NO: 333030 - DNA, 594 bp, Homo sapiens
aatcttcaaggcttcctaggcctcactggttaccctcccagtcccctttgctgtgctgtcctcagtcctaggatttttctcctctctcaactctctttcctatgtgagctcttccacccgcatgaattaaaatctccccaatgtttatctcctacccaaattagtcttctgagcagcagactgacacagccaactgcctacctaccatctccaccaggatatctcactaacaagtccattttaaatagcaaaattgaattcctgagagtctgcttccagtaaagctgactagctcactgcagaccaacatttctgccaagaacaacttaaaaaactgaacaaattattagaaacaactgtttgaaggcatcagagagctacccatgcagtgaggactctggaggccaggattccagagggaaaaggggagtgcagaaaagtgagcccaatcaccggggccccttttctccttgagggattcgccaattcacagcagaagctgggaagccaaaataccaaacagaaacaagtgactgagaatccaagaaggtcagcagaatagccaccagtcttaggggactggtggcacaaaaa

SEQ ID NO: 333031 - DNA, 358 bp, Homo sapiens
gagaggtcaaggtgggttgtataaatttacatttgatcattgagatcaaaaccaggagtactgatgagggtgtagttgagaagagaccctgggtctaagccggtggaatttcaaaggctcacgaatgggtattagaataagtagacccaagggactgagagtgagagggtggcaagggggtgcaagattcagaagactggggtattccggaagcagtggaagagtgtgtttaagaaggagatttgtcaggtccgggcgcagtggctcagacctgtaatcccagcactttgggaggccaaggcgggtgggtcacctcaggtcaggagttcgagaccagcctggccaacatggtgaaacc

SEQ ID NO: 333032 - DNA, 330 bp, Homo sapiens
tccaccaccaccaaaacctaaaagtaaacatctactgctaccagcaccaccaagagtcagacaagtcagaattcagctttcaagttgattaacaacctctgctaaattcacttagaacattcccaactattaaaaagtaaggttgcattgtggaaaatcaaagaaagtggttaatccagatttgctgatgtgttaggtagttgtggcacactcacctgtctttcctaaatgcctctaattatggctatgctattattgggtgattgcatttaatattatttgaggttttgcaagagatatgtgatgtcaaggaataagtaaagacagtgg

SEQ ID NO: 333033 - DNA, 292 bp, Homo sapiens
atcttaaacacgtactgaccacattcccaatctgggccatgacgttgatcaggtgtttatctcctgcttggatcaggcgttggcctcctaatcttttcagtccaaagagttttctttccaaagcacagatctgatcatgtctttccttagcctaaaatatttctgtggtcttcaataaccttgggtcaaagtctgaactccacagcaatttatacgaggcccttcctaagctgacctggctcacctcacctgctgcatttcttgctcctttcctcctcaaactctgaccagt

SEQ ID NO: 333034 - DNA, 197 bp, Homo sapiens
ataatactcagtattagagaaggtaattaataatgtgtgccacaagatgttcattgcagtgtccttccttcctccctcccttctttcctccctccctctttcccttctttgctctctctttcttttttctttatctttttttggtatatgtttgatattggtgaaaaactgaaaaatgaaaatgaccaacaaaaaga

SEQ ID NO: 333035 - DNA, 211 bp, Homo sapiens
gctgttgtgagaatcaaatgaaaacagatatggaaagacacttatagagtgtctggcacatagaaaggtgtcagtgagtgttattttatttccattattattattatcacctagatccaaattctttttttgtgtgtgtaactgggtaaactagaagacgtagttgggaatatcaaaggataacaaagattactgaagtagctgaggatca

SEQ ID NO: 333036 - DNA, 111 bp, Homo sapiens
agaacgaaaaccaaaacaccctatagtttaacacattttaataaattatttcaaaaacctgtttctaaatttccttccactaaaatattataagattattaaatgcagtcg

SEQ ID NO: 333037 - DNA, 169 bp, Homo sapiens
cttgtcttcccccaatccattgaccccagcttaaaatccgtcagcgactccccatcgcactctgggtgaagtccaaacctgtcacagcagccaagaaagttcgtctcttcactccacctccacgatctaagctccaaccacacaggattcagaggccttcttgtgcttg

SEQ ID NO: 333038 - DNA, 542 bp, Homo sapiens
cagccacaggtcatgattaggataaagtatattcacgcactaattaaatcagaacaactgtgcacagacatgcaacagattcaacctcaaagtctgcagaaggaccaaccccgtcaacaccttgatttccgacttgtgagaatacatttctgttttaagccagtttgtggtactttgttaccacagccctaggactgaggtacacatacatatattacacacccagatgtgcacacacacgtgtgagcacgcacacccaattaaggaatctgtctatacaagaggtttactctttgatggctttcatgaaatcacaagctctctatggagtaacccacttttgcactgttaattcactaattgaaaaacagtatttacatccttccctcatttgaactgcatctttaaaatcatctaaatctgtgagttggctctcttcactgtaacaataaaatatcaaccaaaatgcatcacacaattaagacagcagatgttaccctctgggatggagctaaaatgcatctgatgtatctgctgaaaag

SEQ ID NO: 333039 - DNA, 270 bp, Homo sapiens
tttgaatgagaatcaaatccactttccagataccatcaaaggttaaactttgtgaacacacattttcaagtatatgtagtctcaggactgctgttgtgagctttttctctgcacatgaattagtaggactctgttacaaaagatgctacacacccaatgtacagagagacattggggtacctaggaaacacatctttctctccggattcaccaaaaagagacattttcctattctttttttttttttttttccaagatggactctcactc

SEQ ID NO: 333040 - DNA, 205 bp, Homo sapiens
ttgttccttgcattcctgtatttttagatagtattatttttgtacagtagcatgctgtatatgaacacagaggtatataatcattagcatgctatagaactatgttactgtgaatccccccacagccttttaaacattatgaggtggtagttcactttttctcatcttcttatagacaactcatatgtgttaatacttctgtctc

SEQ ID NO: 333041 - DNA, 2683 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333042 - DNA, 402 bp, Homo sapiens
gaaaaaaaggctgatattattttgtggctaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333043 - DNA, 1086 bp, Homo sapiens
acttgtttccgtgggagagatccagccgtggctgtcgacagcagctgccgactgtgcccaatagagaaggtatctgggaaagagcccagcacggggccggggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagacccattggcaacgtagctgtcatcaacgtgggggtccggctgtctaatcaagcttatagataccttgacctcgaggggggcccggt

SEQ ID NO: 333044 - DNA, 1684 bp, Homo sapiens
aggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactcactctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcccggctgctgcacacccttcacctctgcgggatgctgggaccgcatgtttgggcgcggtgggggggccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333045 - DNA, 1081 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctgaccggcaaggcgtccatctgggaaaacggggtcccgggagacttggaggaatcgtcaaagtgtgcgcggacacccgggcgggtactggggaacgcccggggccttgatgcacggaaaaaagttccccggtctccatggccacagtctcaggtaacgcaaaaggtaaaaccaag

SEQ ID NO: 333046 - DNA, 851 bp, Homo sapiens
tcaaaaccacctctacatatagaatgatctcctacatggttagaaggctggttattttgacacagctcaaaacaatttcgaataagttgaaatgacttcagagcctgtggcatgttcttagatgtgatcgaatgactcaacgtaaaaaattctgtccgacgatggatccgatacagccaacgaggagctctaaggttcatcttggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagcacaagaggaccttcgctctggaggtgatgggacgaacactgtggggtatcctgggcctggtgaggggcgtggccggggtggggctggctgtcttccaagaatcttcacacagaaggaaggggggaagaccacgggtgtcaacccagaagaaccggcccggaaaacagggaacataaaagggcgcgcgggcacggaccaatagccacgcggaac

SEQ ID NO: 333047 - DNA, 391 bp, Homo sapiens
ggtcgactactactactaaattcgcggccgcgtcgacgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggcagggactgcttcagtttgtcgacgcggccg

SEQ ID NO: 333048 - DNA, 617 bp, Homo sapiens
gggaaaagacctcctagcaaataacagtgctggaaaactggtaaccctatacaaaagaacctggactacctctcaccatgtataaacgtagcctccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcaggtgggtacgtcactacccacctggcccctgtgatccctgacaggtcaaccttgctggtgaaggcttcctcaatgcccagctggagaagtatgtcgttcaggttatagtccctcgagatagcaaactttggcaggtagagctcacctatctctctgaactccagagagtctctccaccgcttcagggtctctgggagcagcatggcttccacttcctccatcttgtcttgatcagggaggatgaagagtgccctggcgttgcctgtgtacattcagctccaccacgatgcaggacagctcctcgtcccggaagaaggtataatcagttgcgctactccggatcctctagaa

SEQ ID NO: 333049 - DNA, 2799 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaacaaaaaatcggggttatttccggggcggaaaaaggtagacactgggcacggcaacggtcgtggccatttctgcaagggcaaaaggggccaaaggagggaaataagcggag

SEQ ID NO: 333050 - DNA, 2832 bp, Homo sapiens
  misc_feature (2716)..(2716): n is a, c, g, or t
  misc_feature (2735)..(2735): n is a, c, g, or t
  misc_feature (2761)..(2761): n is a, c, g, or t
  misc_feature (2795)..(2795): n is a, c, g, or t
  misc_feature (2801)..(2801): n is a, c, g, or t
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaaaaaaaaaaaaaaaaaaaaaaaaaaaanccacattaacaacataaanccctcattcacacgggaaacaccctnatgttcatacacctttcccccattctcctccttntccctnaaccccgacataattaccgggttttcctttt

SEQ ID NO: 333051 - DNA, 2675 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333052 - DNA, 2623 bp, Homo sapiens
attccagtaaaaggaccccagcatcaacgttcttcctgcagggctgggttctcagagaaagaaaacgtgatgcagcagaggatgggattgaagaaacaggagagtgaagtggaaatagcctggcccgcgtgacttaaaccggcccggagatgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333053 - DNA, 2476 bp, Homo sapiens
cggccagttaaactactaaaacgtgtaccttaaaggtaagccgaaggagcccttgggattgtgccgtgacaatgggttgggactggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333054 - DNA, 2590 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgacactccgtgaatctagtgctagtttatgtaaaaaattaagtgaattaagcagctagattaaagcacgtatgattaacattaatacacaatcgcacgagtgctgat

SEQ ID NO: 333055 - DNA, 2503 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagacggtttccatgcagccgccgcggtgaactcccgtctggtggacactcccccagggcctcggtgtgatggagtttcctgaatcagcgcaggcagacgtgggacacccttgtgcaccttttcattttacttctgtttttaaataaaggccctaaatgctgcttaaaataatga

SEQ ID NO: 333056 - DNA, 2400 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagtaagttggctgggttccctgaggcaataagaccccaatgtgagtacgggacaggggaatggccattgct

SEQ ID NO: 333057 - DNA, 2497 bp, Homo sapiens
acttgtttccgtgggagagatccagccgtggctgtcgacagcagctgccgactgtgcccaatagagaaggtatctgggaaagagcccagcacggggccggggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggggtacgtacctgcggtgggtccggtggacgcggttcaggtgggggaccctcagcatcatctccctgaggctgcaccccacatcctgaatgctcccgtggaaagtcttgaaggggccggcatcccgcttcatacctggcgttaggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333058 - DNA, 1880 bp, Homo sapiens
cgaagaatgatgtatagtcgacacccggtgttatttcgtcacggggcggagctgatgtgtatctatactgcgccgtaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333059 - DNA, 1817 bp, Homo sapiens
ctagtacgaggccgggtgttaatcggccgaggggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333060 - DNA, 1835 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333061 - DNA, 1613 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttcctcccggggaatacattggaagagatcgccctttcgatagggtaccagctcggttcgtatc

SEQ ID NO: 333062 - DNA, 2430 bp, Homo sapiens
aggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactcactctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcccggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333063 - DNA, 1717 bp, Homo sapiens
ctttctgataccggagcgcatttcccagtggaaccccagagcagcaactcaggttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcgggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacacccaccccgctgtgctgcctgcaggcaccccctttcatgaggacctgggctgtgcccaggcggccccctgtgttgctggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333064 - DNA, 916 bp, Homo sapiens
tgcaatttaaaacttacatatttatttctggaattttccatttaatatttgtgggcctcagttgaccactggaccatgggtaacaaactgcagaaagcaaaaccgtgaactggagggactggtgttgatgtagaatcaccatagggttgggggatgcgggagtccagcctcccagggccatctccccaagcagggagccacgtgcccactgcacgctaaacaaagtgactccttctcgctcgtttcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333065 - DNA, 1386 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctgaccggcaaggcgtccatctgggaaaacggggtcccgggagacttggaggaatcgtcaaagtgtgcgcggacacccgggcgggtactggggaacgcccggggccttgatgcacggaaaaaagttccccggtctccatggccacagtctcaggtaacgcaaaaggtaaaaccaag

SEQ ID NO: 333066 - DNA, 1169 bp, Homo sapiens
attccagtaaaaggaccccagcatcaacgttcttcctgcagggctgggttctcagagaaagaaaacgtgatgcagcagaggatgggattgaagaaacaggagagtgaagtggaaatagcctggcccgcgtgacttaaaccggcccggagatgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagctgtccgtccgcaggtgggctatgacacacgtgtgaccatctcgggccgtgcgatgggggccctttgctcgcaggttgggcgcgctgggtgggggggcttgctgttaaggcgccggacccgtgggttgtctatcggacacggtgcgcggtgggggggtgtccgtgcgggggggggggaagggcccgagggggcgcgcacgggcggcgggccacagcttgggcggggcggtgtggactggggggggcgcgggcgc

SEQ ID NO: 333067 - DNA, 280 bp, Homo sapiens
tggacagcacagaggaggtggacagcacagaggaggtggacagcctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333068 - DNA, 593 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtaggtactgggctgcgtccacagggttctctgagttagagactcttttatgtctagtaaattcccagaacacttgagctcagatcagttgcgaaatagagattatgtggacagaacagactttgtgagcagctctttacttgtggtttgatttttagaaatgcatgtgttaatctgtgagtcactttgagtacttgttaatacaaataatccatatttcacca

SEQ ID NO: 333069 - DNA, 407 bp, Homo sapiens
ttagttgacttgttcggtttattaaaatcctcatcttactgagcggggggaacacttgatactttttcttaacaggccaagttcaggctacgggaatcacaggttttgttctgttccaactataaggacctagaaataaaaacatgaattctgcaaaatagaaattgtcatttctatttaacagcaaagtgttactgtataactggtatttcatataactctaaccaccaacagggtggggcaccctctccatttgatagaaactttggaaccaaaatctctgccagagctatggagtggatcactgcaaaactcaaggaggcccggggcagaggtaaggggtctggggagggaggccacagcctcgtgatgcaggccgtcctgccttggtgaaaatgctgtcctat

SEQ ID NO: 333070 - DNA, 560 bp, Homo sapiens
atggagtggatcactgcatagctctggcagagattttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333071 - DNA, 1047 bp, Homo sapiens
ctttctgataccggagcgcatttcccagtggaaccccagagcagcaactcaggttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcgggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacacccaccccgctgtgctgcctgcaggcaccccctttcatgaggacctgggctgtgcccaggcggccccctgtgttgctggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctctcattgcttttccgtcatttattttagcaacttgtttcttctgtgctaaggatgagccggatttattcttcttcttttctcccctttgttagcttggctttatgtcacactggccagaacagggtaaaatttttttagcttctctgccttagggagagcctgtctttattgattaaaagtgagatgatatatccag

SEQ ID NO: 333072 - DNA, 675 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaagggctgggttctcagagaaagaaaacgtgatgcagcagaggatgggattgaagaaacaggagagtgaagtggaaatagcctggcccgcgtgacttaaaccggcccggagatgtgcgggtacgaatggagccgccttggggtcgggataggacccagagtggcttctcagtcaaaggccttcagaagcagagggagcaccttgagtgaccttacctgggccgcgaaagacaagaaacctttggcacaggaagaggaactgatctctggaagccaccagggcgggtggaaagtcagggtttcaaggttattttggaatttaggtgctgtgggccttgtacggtggctcatgcttgtcatcccagtgctttgggaggccgaggcaggaggctcgcttgagccgaggagttccagagcatcctgggcaacatagtgagactctgtgtctacaaaaaaaaagaa

SEQ ID NO: 333073 - DNA, 776 bp, Homo sapiens
  misc_feature (761)..(761): n is a, c, g, or t
acttgtttccgtgggagagatccagccgtggctgtcgacagcagctgccgactgtgcccaatagagaaggtatctgggaaagagcccagcacggggccggggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggggtacgtacctgcggtgggtccggtggacgcggttcaggtgggggaccctcagcatcatctccctgaggctgcaccccacatcctgaatgctcccgtggaaagtcttgaaggggccggcatcccgcttcatacctggcgttaggtacctggccctggtgagtgccttggcctgcggtgcggactgggtgttccttccagaatctccaccagaggaaggctgggaggagcagatgtgtgtcaaactctcggagaaccgtgcccggaaaaacaggtgaatatattattgtgctgcggaatcgggatctctagagtgactgangatgaagctggactg

SEQ ID NO: 333074 - DNA, 3035 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaaaaacaaacaactcagggacacatagacggagacggaaaagagagtcagcacgtgaccggggcatagcgggaccccaacccactactgtgaccaagccgcacacagcggacacccaacaggagaagcgatacacgaaaccacgggtcaccgctagacacccggcgggcaacaaaacagcaagcaagacaagaacagacaaaggcacacaaatgacaagaaaagcgtaaagacacaccacaacgacacacaacagcacacgcagcccacagagagaaccaccaagaccacaacgcacaagcgaacgcgccacagcaaagaacacaaaaaagagcacacaacgaccaca

SEQ ID NO: 333075 - DNA, 3121 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaaaaaaaaaaaaaaaaaaaaaaaaaaaaaaaaaaaaaaaaaaaagaggggggggcgccgccaaaaaaaacacccccgggggggcccccataaggggcccccctttttgtgtggaaaaaggggggccccccaggggggggggtataaagagggggggcagcgggccgcgcgggttaaaaaagggctggggagcgggggaaaaaaagcgtgggcatggcggggaatctttgggggagagagaacccatttcttcggggggcggggcgacatatagtggggcacaacaacatactccaagagagatatttaaagcgcctcggggggaacatatatcactttgcggggtgtaattggtgtgtcaaaccagacggtgactatgtaggtgccgtggtaaaaaaatttggcactagcgagatatgtattaccaaaaaatattagagg

SEQ ID NO: 333076 - DNA, 2530 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333077 - DNA, 2537 bp, Homo sapiens
ttaaggaagttcacctccagatgtactcagagggcctggtcttagctgccacagatttacaaacccttacagtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333078 - DNA, 2799 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaagggctgggttctcagagaaagaaaacgtgatgcagcagaggatgggattgaagaaacaggagagtgaagtggaaatagcctggcccgcgtgacttaaaccggcccggagatgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333079 - DNA, 2416 bp, Homo sapiens
tcggctaggtacgaggctgggtttggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333080 - DNA, 2638 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagaggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333081 - DNA, 2353 bp, Homo sapiens
acttgtttccgtgggagagatccagccgtggctgtcgacagcagctgccgactgtgcccaatagagaaggtatctgggaaagagcccagcacggggccggggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333082 - DNA, 2125 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacgtaagtccgtgtgcgccctgccaggcgggcgccggctgacgctaaccccggggccccggcccttttttatctaccagtgcgctagaaatagccttttacaaataccctgaatgagagcttctcgttctttttttcccccagaaaagtatgttttaagactctgaaaatttttgaactcactcccagaaagttttaccacctctttttctgtgtggccaccagggggacgtagtgtggccgagactccaggggtgcccgtgagcacccgaggcgctgaggagggctgggtcgcagtctcctgtgattgtaccagcattaaaaatcgctttgtgtgtga

SEQ ID NO: 333083 - DNA, 1865 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgaggtgtgagccaccgcgcccagcccgttattaaatatttttacccaacaattttaacctattaagagctttaaaaaaatctgatt

SEQ ID NO: 333084 - DNA, 1416 bp, Homo sapiens
ggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagacccattggcaacgtagctgtcatcaacgtgggggtccggctgtctaatcaagcttatagataccttgacctcgaggggggcccggt

SEQ ID NO: 333085 - DNA, 751 bp, Homo sapiens
cgcggcgcctgatgtcgaaggtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333086 - DNA, 726 bp, Homo sapiens
tgtagttttcactgcagctctcatttctgagcacaaggcctctctggatggtggtcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333087 - DNA, 505 bp, Homo sapiens
caggtggttgtgggtcggctttatcatctagttgattcagccgaccctacaaaccctgtgtttctggcaagaccgctcgctgtgctggccaggcggaggcatctcccgccagtgactgcaggcctcactgctgtctcctcttacctccacaggcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactccaa

SEQ ID NO: 333088 - DNA, 300 bp, Homo sapiens
tggggttaggatgcgttcgcatctgtttgcacttgtgaaaagaaaccgcaggaggatgaatgcattggcaacagtggggagctgagtcggtgagccacaggggagttctcggtgctgaaactattctggatgatgctgtgatgacagatacatgactccatttcccaaaagacattgaactttacagcacagggagccttaatgtgtgcgctttttttgttttttttgagacggagtttcgctcttgttgcccaggctgtagtgtaactgctcaatctcggctccccacaacctccgcat

SEQ ID NO: 333089 - DNA, 880 bp, Homo sapiens
agctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggagacttatgaccccaatcatgtatgctgctcgagatggtcacacccaggttgttgctctccttgttgctcatggagcagaagttaatacccaggatgagaatggttacactgctttaacgtgggcagcacgtcagggtcataaaaatatagttttgaagttgcttgaacttggagctaataaaatgctacaaaccaaagatggaaagatgccaagtgagattgcaaaaagaaacaaacatcatgagatcttcaacttactttcttttactttaaatccattggaaggaaaacttcaacagctaactaaagaagacactatttgtaacaatattgacaacagattctgatagagaaaaagatcacattttaggttcatatacatgttttagttcaa

SEQ ID NO: 333090 - DNA, 768 bp, Homo sapiens
agctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggctttaacgtgggcagcacgtcagggtcataaaaatatagttttgaagttgcttgaacttggagctaataaaatgctacaaaccaaagatggaaagatgccaagtgagattgcaaaaagaaacaaacatcatgagatcttcaacttactttcttttactttaaatccattggaaggaaaacttcaacagctaactaaagaagacactatttgtaacaatattgacaacagattctgatagagaaaaagatcacattttaggttcatatacatgttttagttcaa

SEQ ID NO: 333091 - DNA, 728 bp, Homo sapiens
agctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggctttaacgtgggcagcacgtcagggtcataaaaatatagttttgaagttgcttgaacttggagctaataaaatgctacaaaccaaagatggaaagatgccaagtgagattgcaaaaagaaacaaacatcatgaggaaaacttcaacagctaactaaagaagacactatttgtaacaatattgacaacagattctgatagagaaaaagatcacattttaggttcatatacatgttttagttcaa

SEQ ID NO: 333092 - DNA, 757 bp, Homo sapiens
agctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctgataagcaaagtattttgataactgcatgttctgctcatggctcagaggaacagatcttgaagtgtgtagaactactactttcaagaaatgctgatccaaatgttgcttgtaggagacttatgaccccaatcatgtatgctgctcgagatggtcacacccaggttgttgctctccttgttgctcatggagcagaagttaatacccaggatgagaatggttacactgctttaacgtgggcagcacgtcagggtcataaaaatatagttttgaagttgcttgaacttggagctaataaaatgctacaaaccaaagatggaaagatgccaagtgagattgcaaaaagaaacaaacatcatgagatcttcaacttactttcttttactttaaatccattggaaggaaaacttcaacagctaactaaagaagacactatttgtaacaatattgacaacagattctgatagagaaaaagatcacattttaggttcatatacatgttttagttcaa

SEQ ID NO: 333093 - DNA, 1046 bp, Homo sapiens
tcgagtgggcggatggacgcggctggagattggatagctcctattgcactgaaaggtgcattgcagtttgaggcccaggagtcagaagcttttctaggctgggacgtgggagggactgtgcagataattcaagaatgaggagagtctgacctggatatctgggagctctccctcctggcagcggaggcggggtattccggggtagaataccggtagagttcttagcttttctatctggattttatgtcagcgacacagcccgatggacagggcaaccccaaccaatccctgcaccctcccttccctccaccctcctgagaattacccacagaaccagggagacagacttgaaacccacgctgaaaccctcacctctgcctatacctccattcttagtctcaagcccccaccctggcagaagctgaggaacactgctcttgtgtagacagtagctctctctggtggggtggaatatttcctagggctactggctccaccgaggtgatgatgagaatggtctttgctttctgagtttgtttttccaactgtaaaatgtggatactatttcccagctgcttttcttgttgtgactatcaagagatggcactgtgttaatttatccattgattcaataaatactttttagcaccaagaatgagttaggactcagcagttctcagtccacactgttggaggtttctaaaatatactgaaacctgattcaatcccatgcttagcttggccgattaaatcagaatctctggggtggccctgggtgcccttaagggtcacaaagatgatctgatgtagactctgctctccaggaggttctgggcgtatttgccacggataatcctaatgtaaagtagaaagtgaaggacatgcagacagggagccctggaagtgcccgggtggtaagattgtctgtatttcacaaacaactggggtcaaagcaaggtgctgtgctatttatttatttttattttatttatttatttatttttgagacagagttttgctcttgttgcccaggctggagtgcaatg

SEQ ID NO: 333094 - DNA, 858 bp, Homo sapiens
cttgaactggacccctaccttttaccagagaaaaaaagtcaatttgagatgaaacaaagactttaatataagacctaaaactataaaatgtcatataagaaaacctagagaatacccttcttgacgtcagctttggcaaataattcataactaagtcctcaaaagcaatttcaaccaaaagaaaaatggataagttggacctgattaaattaaagggtttctgcacaataaaagaaactatcaacagggtaaacagacagagagaaaatatttgcaaactatgcatccaacagagatctaatatccactatctctaagaaacttgaacaaatcaacaagcaaaagatgaacagccctgttaagaagtgggcaaaaaacatgaacaggctcttctcagaagacatacatgtcgccaacaaacatatgaaaaactactcaaaatcacaagtcaggaaagaaatgcgaatgaaagccataatgaagtaccatcacacaccagtcagaatggctactattaaaaagtaaaaaaataacagatgttgacagggttgtggagaaaagggaatgcgtgttcattattggtgggaatgtaaactatttcagtgcctgtggaacgaaacttggagatatctcaaagaacttacaaaagaacgacgattcgacccagcaattccattactggctttatatccaaaggaaaataaattattctaccaaaaagacacatacattcatatgttcatcaaaacactattcacattaatgaggacatggaatcaatgtagatgtccatcagctatggactggataaagaaaatgtggtacaaacataacatggaatactatgcagccataaaa

SEQ ID NO: 333095 - DNA, 260 bp, Homo sapiens
tttgtctcaaaaaaaagtcattcaagtgactactccagaccagagaaagctgcaaattaacaaagggtgattctgggacaggcggaaatacatgtgggcactgggctggagtgatatcaccatgtctgagaatagcctcttctcagcagccccgaatcggaaatacatagttccagaagtcaaatacatcttgattttgatctcggctagactgcttacttttttttttttttttttaagctgtaaaatgagataatgcc

SEQ ID NO: 333096 - DNA, 811 bp, Homo sapiens
gactattcacaggcataatcataatgcaccatagcctcaaactcctgggctcaagcaatccaaaaggaggaaacttttaacttatgatcagtttctaccataaatcaagcaacttagaaaaaccttagaacagggtttctcaaaccaagcattgttagtatttggggttggttaagtctttgtttgtgggagcctatcctgtgcattgtaggatttctagcagcataattggcttatgcccacttgatgtcattagcaccactccccaccctacttccagttgtgacaacccaaaaatgtctccagacatagccaactgtccctgggtgttgcgagtataggaggcaaaattgcaccctgttgaaaaccaccaccttagatcatctaggttttacttttaggataagacacttgagggaaaggctgtgaaactgaacctctgttagaagcaacacacagtatcactgcaaaaagactaaaagaaataggtgatttggaaagaggaggcccaggattaaaatatgtttccaagaaagtcaaatcttacaggagactcttgacttcacatctgctgatccctttacccgataggacctagagcagccattataaatctctgtacctgcttgctgcttttctacctcattgttagccacacccagtttgaaacagatgaggtatgctatttcataactagtacatcttttaataagcattttttattgtgattaaatatgcatatcgaatcattcagcgctagagccggccttctagtgatcactgtctgcggcctgaagaaggagggaaaggc

SEQ ID NO: 333097 - DNA, 2099 bp, Homo sapiens
  misc_feature (2098)..(2098): n is a, c, g, or t
gactattcacaggcataatcataatgcaccatagcctcaaactcctgggctcaagcaatccaaaaggaggaaacttttaacttatgatcagtttctaccataaatcaagcaacttagaaaaaccttagaacagggtttctcaaaccaagcattgttagtatttggggttggttaagtctttgtttgtgggagcctatcctgtgcattgtaggatttctagcagcataattggcttatgcccacttgatgtcattagcaccactccccaccctacttccagttgtgacaacccaaaaatgtctccagacatagccaactgtccctgggtgttgcgagtataggaggcaaaattgcaccctgttgaaaaccaccaccttagatcatctaggttttacttttaggataagacacttgagggaaaggctgtgaaactgaacctctgttagaagcaacacacagtatcactgcaaaaagactaaaagaaataggtgatttggaaagaggaggcccaggattaaaatatgtttccaagaaagtcaaatcttacaggagactcttgacttcacatctgctgatccctttacccgataggacctagagcagccattataaatctctgtacctgcttgctgcttttctacctcattgttagccacacccagtttgaaacagatgaggtatgctatttcataactagtacatcttttaataagcattttttattgtgattaaatatgcatatcgtaaaattcaccactttaaccagttttaagtgttcaattctgtggcattaagtatattcatactattgtgcaaccaccaccaccatccgtctacagaactcttcatcttcccaaactgaaattatgtattcattaaacaataaccacccattacctcctctctcctcagcctctggtaaccagcattcagtctctatgcattgactactctagatatctaaatggattcattcttatttcatttaccataatgtcttcaaagttcattcatgttgtagcatgtattagaatttctttcctcttaaaggccaaatatgccgtagtatgtaaataccgtattttgtttatcagttcatccattaatggacactgggttgcttctgctttttggctattgtgaataatgcttctgtgaacgtgggtatacaaataactgtttgagtcctaataggcttgttatttttgagtgcacagatctgtatattcgcaattgaaatagggaaagtctttatattcatataaagataatttataatacaataagtcctcaatgttgttgataggttctgggaaactgcaagtttaagaaaaacaacatataatgaaatcaattttaccataggtgaactgatataaataagagttaagtccctatggcatatatttctggttacaaaaacactaccaaatttctaataaagacccaaaacacttctaaaattaaacattgagattaatatgagctttatatacatttaaaaaggataaaaacaagtaagaattggctggacatggtggcttacgcctgtaatctcaacactgggaagtcgaggtgggcagatggcttgacctcaggagttcggaaccagcctgggtaatatggtgaaacccgtctctacagaaaaattcaaaaattagccagaggtggtggcttgcacctgtagtcccagctactcgggagcctgatgtgggaggatcccttgagcctgggaggtcgaggctgcagtgagccatgatcacgctactgcactccagtctgggcaacagagcaaaatcctatctcaaaaaatatatatatattatccagccccaaatgtttatggggttgttattgataaaccctgcattaaacaatcccacagtcggtgctgcggtgagccgtgatggtaccactgcattccagcctgggtgacagaatgagaccctgtctcaaaaaaaaaagtaaaaattatttacccaatatttggcgaatcagtgagtgacagcagttgtagtgctagtgggttaaatcaaggaataactgttgggaagtgaaaattttaaggagcacctcctaccaccatgcagttcaaaanc

SEQ ID NO: 333098 - DNA, 1575 bp, Homo sapiens
gactattcacaggcataatcataatgcaccatagcctcaaactcctgggctcaagcaatccaaaaggaggaaacttttaacttatgatcagtttctaccataaatcaagcaacttagaaaaaccttagaacagggtttctcaaaccaagcattgttagtatttggggttggttaagtctttgtttgtgggagcctatcctgtgcattgtaggatttctagcagcataattggcttatgcccacttgatgtcattagcaccactccccaccctacttccagttgtgacaacccaaaaatgtctccagacatagccaactgtccctgggtgttgcgagtataggaggcaaaattgcaccctgttgaaaaccaccaccttagatcatctaggttttacttttaggataagacacttgagggaaaggctgtgaaactgaacctctgttagaagcaacacacagtatcactgcaaaaagactaaaagaaataggtgatttggaaagaggaggcccaggattaaaatatgtttccaagaaagtcaaatcttacaggagactcttgacttcacatctgctgatccctttacccgataggacctagagcagccattataaatctctgtacctgcttgctgcttttctacctcattgttagccacacccagtttgaaacagatgaggtatgctatttcataactagtacatcttttaataagcattttttattgtgattaaatatgcatatcgtaaaattcaccactttaaccagttttaagtgttcaattctgtggcattaagtatattcatactattgtgcaaccaccaccaccatccgtctacagaactcttcatcttcccaaactgaaattatgtattcattaaacaataaccacccattacctcctctctcctcagcctctggtaaccagcattcagtctctatgcattgactactctagatatctaaatggattcattcttatttcatttaccataatgtcttcaaagttcattcatgttgtagcatgtattagaatttctttcctcttaaaggccaaatatgccgtagtatgtaaataccgtattttgtttatcagttcatccattaatggacactgggttgcttctgctttttggctattgtgaataatgcttctgtgaacgtgggtatacaaataactgtttgagtcctaataggcttgttatttttgagtgcacagatctgtatattcgcaattgaaatagggaaagtctttatattcatataaagataatttataatacaaaaaaaaaaaaaaaaacaaaaaaaaaaaacaaagaaccaaaaaaagaaaaaagcaccaggaaaagaaacaaacaccgagaagtcacagacgaggtgcaaataacgccgtccacggaacgtagagaaagaacaaagaacgaaccaacacaaagacaacaagcacacaaaagaaacaaaaaagcaaacagcaaaacaacaaaggagaggagcgacagagaacagaacaaagaaagaagcaaaagaacagaaaagaaagaaaccaacaatgaagggacaaacaacagaaccacagc

SEQ ID NO: 333099 - DNA, 4396 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcactgatttgtccaggatcgagctctgtttgacctgttctgctagtatagtaagctggctccctgatgggggaagtgagagggagaggagctggctggctggttgcttagaaactatgcttgatatctaaatagaaatgggtgccaaagtctgaaagtcacccagcctgtggagtgaaagctcacaaatttggcttctaaagggaagctgttgacacagaaagcctagggattctgtggaagaataggttgtcaggcatttaccttattaccactcaaataccagtgtgtgtgtgttgggggggcggcagggagagggggtaggtgacagtatgtgactcaggtgttagctttaagaggaaagagctctatttttcttgttttcttctctgagctagactgagctggggatctaagatgtacttctctgactacaaaagggacagtatcatttagattttttgcagttggaagaaatgggttgttgagtgtgttaaggctgggatgaagaagggctgggcagtactcttctggaaaggctcacctagcacgaacctgcttgtctcccttactagtggaggtatctgagtgtgaacagtgaaggtaaagagtggtatagaacaatgcagctgtatctgtcacaaactggtcttatctagaaacatctgctgagtctctaaccctttcagctttctcttcttttttgagacagagtcttgctttgttgcccaggctggagtgcagtggcaagtcaccacttactgcagctttaagctcctgggctcaagcaatcgtcctgccccagcctcctgagtagttgggacaacagtcgtgcactatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctatgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaa

SEQ ID NO: 333100 - DNA, 5073 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcactgatttgtccaggatcgagctctgtttgacctgttctgctagtatagtaagctggctccctgatgggggaagtgagagggagaggagctggctggctggttgcttagaaactatgcttgatatctaaatagaaatgggtgccaaagtctgaaagtcacccagcctgtggagtgaaagctcacaaatttggcttctaaagggaagctgttgacacagaaagcctagggattctgtggaagaataggttgtcaggcatttaccttattaccactcaaataccagtgtgtgtgtgttgggggggcggcagggagagggggtaggtgacagtatgtgactcaggtgttagctttaagaggaaagagctctatttttcttgttttcttctctgagctagactgagctggggatctaagatgtacttctctgactacaaaagggacagtatcatttagattttttgcagttggaagaaatgggttgttgagtgtgttaaggctgggatgaagaagggctgggcagtactcttctggaaaggctcacctagcacgaacctgcttgtctcccttactagtggaggtatctgagtgtgaacagtgaaggtaaagagtggtatagaacaatgcagctgtatctgtcacaaactggtcttatctagaaacatctgctgagtctctaaccctttcagctttctcttcttttttgagacagagtcttgctttgttgcccaggctggagtgcagtggcaagtcaccacttactgcagctttaagctcctgggctcaagcaatcgtcctgccccagcctcctgagtagttgggacaacagtcgtgcactatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctatgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaatcagtcttttagggatttactgttaaccaccatgggaaaattaaataaatgcggggaaggaaaacgttctaaaattagaagactactttctactctcagcttctgattccctctgagctaagaaccagacagccttaggctggtaactcctataagctggtcctcctcccatgctgaccccatctttactgtacaattcacttttcatggactgaaggcaccaccaagatagatccaggagtgacaactccagtgtaggtgtccactgttcccttaatctctgtcctgctccaagtataaataaattggggccatttccttagatattggggttttctcaagaaatcctttcccttcgtggcatgggtcaaatcgctggtagttaaaaaggtgttaactcttacgtgaaataacactttttctttgtaatgacctggctggaaagcctctgtgtcatcacttctcatttcttatttgaaatcagcaaactggattcagtagacatgaacttaagccccatgaaagtgggggttttgtctgttttgctcactgcagtacctccagggcctagcagcatgactggcacatatttgttcaaagtgaatactcacaccttcacaccctccctagagagctgttgtaggcctctcaaatgtaggatttagggaagtcaagtt

SEQ ID NO: 333101 - DNA, 4037 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacattttatgtgactcaggtgttagctttaagaggaaagagctctatttttcttgttttcttctctgagctagactgagctggggatctaagatgtacttctctgactacaaaagggacagtatcatttagattttttgcagttggaagaaatgggttgttgagtgtgttaaggctgggatgaagaagggctgggcagtactcttctggaaaggctcacctagcacgaacctgcttgtctcccttactagtggaggtatctgagtgtgaacagtgaaggtaaagagtggtatagaacaatgcagctgtatctgtcacaaactggtcttatctagaaacatctgctgagtctctaaccctttcagctttctcttcttttttgagacagagtcttgctttgttgcccaggctggagtgcagtggcaagtcaccacttactgcagctttaagctcctgggctcaagcaatcgtcctgccccagcctcctgagtagttgggacaacagtcgtgcactatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctatgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaa

SEQ ID NO: 333102 - DNA, 3972 bp, Homo sapiens
acctgttggcaaacgtgcagttcgattcgagctcggaccttgcgaggaattgaccttgcgatggaattgacctccagagaaaactcacatgtctatgttaatcttcagcaaacaaaggtttttaaaactatgaatttgtgggagaaataatatgactaggaagcaggagcaggggaaccttatttcttattgcgttagttatgggaatcactgatgggctggaagatcacactgggtcagggttcagtgtttggttcttgtctactgaccttgtgagttctcagagcatcagcaagtgatgtgcacgtgtggtacccctgtctgctcaccatatgcttttgttttaggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcactgatttgtccaggatcgagctctgtttgacctgttctgctagtatagtaagctggctccctgatgggggaagtgagagggagaggagctggctggctggttgcttagaaactatgcttgatatctaaatagaaatgggtgccaaagtctgaaagtcacccagcctgtggagtgaaagctcacaaatttggcttctaaagggaagctgttgacacagaaagcctagggattctgtggaagaataggttgtcaggcatttaccttattaccactcaaataccagtgtgtgtgtgttgggggggcggcagggagagggggtaggtgacagtatgtgactcaggtgttagctttaagaggaaagagctctatttttcttgttttcttctctgagctagactgagctggggatctaagatgtacttctctgactacaaaagggacagtatcatttagattttttgcagttggaagaaatgggttgttgagtgtgttaaggctgggatgaagaagggctgggcagtactcttctggaaaggctcacctagcacgaacctgcttgtctcccttactagtggaggtatctgagtgtgaacagtgaaggtaaagagtggtatagaacaatgcagctgtatctgtcacaaactggtcttatctagaaacatctgctgagtctctaaccctttcagctttctcttcttttttgagacagagtcttgctttgttgcccaggctggagtgcagtggcaagtcaccacttactgcagctttaagctcctgggctcaagcaatcgtcctgccccagcctcctgagtagttgggacaacagtcgtgcactatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctatgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaa

SEQ ID NO: 333103 - DNA, 2775 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcactgatttgtccaggatcgagctctgtttgacctgttctgctagtatagtaagctggctccctgatgggggaagtgagagggagaggagctggctggctggttgcttagaaactatgcttgatatctaaatagaaatgggtgccaaagtctgaaagtcacccagcctgtggagtgaaagctcacaaatttggcttctaaagggaagctgttgacacagaaagcctagggattctgtggaagaataggttgtcaggcatttaccttattaccactcaaataccagtgtgtgtgtgttgggggggcggcagggagagggggtaggtgacagtatgtgactcaggtgttagctttaagaggaaagagctctatttttcttgttttcttctctgagctagactgagctggggatctaagatgtacttctctgactacaaaagggacaaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaa

SEQ ID NO: 333104 - DNA, 1424 bp, Homo sapiens
  misc_feature (20)..(20): n is a, c, g, or t
ggcttgttctagaggatccngggcaggtgctatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctatgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaa

SEQ ID NO: 333105 - DNA, 1505 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcggtaagtcatttctcagaaagttgatcgtgggaatcactctctggaagtacattccttccactatccctgtctttcaccttcctgctttcctggcatggcaaagatcttaaaaaatttagtctggaggaggtcaagggagaacagaactttggttctaaaaattggaggtgacctaggcaaca

SEQ ID NO: 333106 - DNA, 806 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggtgagtggggatgatgggtggtacagagacatatg

SEQ ID NO: 333107 - DNA, 358 bp, Homo sapiens
ggaatataaatttattctaggaagtggcagcaaggccacttgggctttgcccctggagttgtgtagcaaggcaagcaatagatgatattttgtaaaaagtcttgcaaagtaagcagtcatttatttaggcctgtgatgtaatgttacatctaggttctttaccttcatttgaaccaacttccacagtgagccttggcagaaggatggtccagagagatgaaggcatatcctatatttagacatcagaatggggtcttcctcagggcctctttggtctgtccttcaatcttgggtccattgtgctatttaaaaataccttttcctcagaggatacacctgtgttctgtgtcctgaacag

SEQ ID NO: 333108 - DNA, 4447 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcactgatttgtccaggatcgagctctgtttgacctgttctgctagtatagtaagctggctccctgatgggggaagtgagagggagaggagctggctggctggttgcttagaaactatgcttgatatctaaatagaaatgggtgccaaagtctgaaagtcacccagcctgtggagtgaaagctcacaaatttggcttctaaagggaagctgttgacacagaaagcctagggattctgtggaagaataggttgtcaggcatttaccttattaccactcaaataccagtgtgtgtgtgttgggggggcggcagggagagggggtaggtgacagtatgtgactcaggtgttagctttaagaggaaagagctctatttttcttgttttcttctctgagctagactgagctggggatctaagatgtacttctctgactacaaaagggacagtatcatttagattttttgcagttggaagaaatgggttgttgagtgtgttaaggctgggatgaagaagggctgggcagtactcttctggaaaggctcacctagcacgaacctgcttgtctcccttactagtggaggtatctgagtgtgaacagtgaaggtaaagagtggtatagaacaatgcagctgtatctgtcacaaactggtcttatctagaaacatctgctgagtctctaaccctttcagctttctcttcttttttgagacagagtcttgctttgttgcccaggctggagtgcagtggcaagtcaccacttactgcagctttaagctcctgggctcaagcaatcgtcctgccccagcctcctgagtagttgggacaacagtcgtgcactatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctatgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaaaaaaaaagaaggacaaagaataccaggatcaaagaaaaaagggggggcgcg

SEQ ID NO: 333109 - DNA, 4260 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaatctttgagcggtcaagggaaagacaagccgacttctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcactgatttgtccaggatcgagctctgtttgacctgttctgctagtatagtaagctggctccctgatgggggaagtgagagggagaggagctggctggctggttgcttagaaactatgcttgatatctaaatagaaatgggtgccaaagtctgaaagtcacccagcctgtggagtgaaagctcacaaatttggcttctaaagggaagctgttgacacagaaagcctagggattctgtggaagaataggttgtcaggcatttaccttattaccactcaaataccagtgtgtgtgtgttgggggggcggcagggagagggggtaggtgacagtatgtgactcaggtgttagctttaagaggaaagagctctatttttcttgttttcttctctgagctagactgagctggggatctaagatgtacttctctgactacaaaagggacagtatcatttagattttttgcagttggaagaaatgggttgttgagtgtgttaaggctgggatgaagaagggctgggcagtactcttctggaaaggctcacctagcacgaacctgcttgtctcccttactagtggaggtatctgagtgtgaacagtgaaggtaaagagtggtatagaacaatgcagctgtatctgtcacaaactggtcttatctagaaacatctgctgagtctctaaccctttcagctttctcttcttttttgagacagagtcttgctttgttgcccaggctggagtgcagtggcaagtcaccacttactgcagctttaagctcctgggctcaagcaatcgtcctgccccagcctcctgagtagttgggacaacagtcgtgcactatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctatgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaa

SEQ ID NO: 333110 - DNA, 3521 bp, Homo sapiens
tcattaagcggagcagaagctgttcactagcaagctgctggacgtcatggacagatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcactgatttgtccaggatcgagctctgtttgacctgttctgctagtatagtaagctggctccctgatgggggaagtgagagggagaggagctggctggctggttgcttagaaactatgcttgatatctaaatagaaatgggtgccaaagtctgaaagtcacccagcctgtggagtgaaagctcacaaatttggcttctaaagggaagctgttgacacagaaagcctagggattctgtggaagaataggttgtcaggcatttaccttattaccactcaaataccagtgtgtgtgtgttgggggggcggcagggagagggggtaggtgacagtatgtgactcaggtgttagctttaagaggaaagagctctatttttcttgttttcttctctgagctagactgagctggggatctaagatgtacttctctgactacaaaagggacagtatcatttagattttttgcagttggaagaaatgggttgttgagtgtgttaaggctgggatgaagaagggctgggcagtactcttctggaaaggctcacctagcacgaacctgcttgtctcccttactagtggaggtatctgagtgtgaacagtgaaggtaaagagtggtatagaacaatgcagctgtatctgtcacaaactggtcttatctagaaacatctgctgagtctctaaccctttcagctttctcttcttttttgagacagagtcttgctttgttgcccaggctggagtgcagtggcaagtcaccacttactgcagctttaagctcctgggctcaagcaatcgtcctgccccagcctcctgagtagttgggacaacagtcgtgcactatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctatgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaa

SEQ ID NO: 333111 - DNA, 1493 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcacggtcatggtctgcccgtactccttcccacggtactgaaacttgatgtccaggtcagtcattgggagagagctgatccacagttctggagagctatagaagggctgtataggtgcctggggtacttccatctccaggggttcagttttgggccacactgcctccgggctgcagttgcccacactcaattcccacactggctgcgccatggagtaatgcaggtaccgagt

SEQ ID NO: 333112 - DNA, 244 bp, Homo sapiens
agaggggagatgagagaagcagatgagggaagggcagcagagtggtcagtgataataatgaattgacattcttaccagatacatttctgattacaagctaaaaagaataggatctctccagcctgtgtatgtctcctcttccctggaggagaggcaggagtcatattattcattaatctatgtcttagcccaagtttcctacaaaaaaaagaaaggattctgaggcaaagtttacatgctattg

SEQ ID NO: 333113 - DNA, 406 bp, Homo sapiens
gctgaggcaggaagattgcttgaaggtaggagttcgtgactgcctgggcaacatagtgagaccctgtctctaaaattttttaaaaaaaaatttagctgggcatggtggtgtgctcctgaggctaaggcaggaggatcccttgaggccaggagttcaaaaccaacctgggcacctacagaaaaacaagtgtttgtcaccttcctgccctttcacaggatacagataagaagggagtaacaccagcagctggtttttatgccgccctgtgtagctcatttgcttcatttctgttcaaagggtccttggaaattgcttattcctaccacctaaaactacacctgccatagttagtgctccaaatttgtcgaataattttccctttttaaattctggttcccactgctgc

SEQ ID NO: 333114 - DNA, 259 bp, Homo sapiens
ttaatgggtgcagcacaccaacatggcacatgtatacatatgtaacaaacttacacattgcgcacatgtaccctagaacttaaagtataattaaaaaaaaagaaatttaatctccaatgtagcagtattgacaagtggagcctttaagaggtaactcaatcatgaaagctctgtcctaatgaatgaattaatgggttaatgaattaatgaagcatcataggaggagaactagtggctgtataagagaagaaagacctga

SEQ ID NO: 333115 - DNA, 458 bp, Homo sapiens
tctttgtttttgtctcaaaatttgcacattgtccagttccatattaggtacttaagtcattattgaatgaataggattgatggggcagaggatcaaaggactgaatctttggggaagagtcaagcactattgaggggtaaaaggagaaagaaaactgcatactataaaagtttatggtctattctgacttctctccccctttgaaacttttttttttctccttgctgcattttcatccattatcctgagacctatttccacagtttatctcagtcagttaggataaagtttagtataatatcatctacatttctggagtcttattgcaaagaccctgtatgagatggtcacctgatcaggatcatttaattgcaactagattttcagctttttaggggtatgaacaacagtgcatgcactgttgttcatacctgtatcgggggtagggcaccaggttg

SEQ ID NO: 333116 - DNA, 551 bp, Homo sapiens
atcctatcacatgaataccttgcagttcacttcagcaatgcattatctttaggcttgtaagcagtttctaattattcaaacattttgttttctatacctggcatatagtgaatgcctaataaatatttaggaaacaaatatcattaagaacattcttacggttaaatctttaagcataccaattgacttatttgctttggatatattccttagaagtggaattgctgggtcaatctatgtgtgcatattaagaagccatgacacacagaaagatggggacaggacacttgctcctgtaggctagagaaagcctggcttcctgcagttttgaggaccagagtgtcctcctccaggaactcttgtagcctattatctccagaaagtggaactgggtctgctactcttttatctgttgagttttccaagagttacccaagagttcaacataactatactcctctggagctctgtccagcctgcctactgaattaggcttccccccatcaactgcctggtgcctgcttgatctgagcatttgtggccctctcaac

SEQ ID NO: 333117 - DNA, 462 bp, Homo sapiens
ccttcctctttctatatgtcatatggtgggaaatgccctttagtacttactcaggagttagttcctctgggaagccttctgttctagtttccttttgttacagcactttcacattgaattctgacgttctctgtacttatctgctttgtgagactgtgagcttccttaggcagtagctacttgtattcttagcaccttgcccagtgccaggaaacccttattaagtaaatgaaaagacagaactgacagactggaattagagctcaagcttgcctcaatctcaagccattaagatgaaggggagccgggcgtggtggctcacgcctctaatcccagcactttaggaggtagtttgcttgagcccaggagttcaagaccagcctgggcaacgtggcaaaaccccatttctacaaaaaatataaaaattagttgggcgtgggggtgtgtgcctgtactcaggat

SEQ ID NO: 333118 - DNA, 365 bp, Homo sapiens
ctcctgcacccgttggatttctttctaggctgccaattctgttctattaggatggataaagagggacaaagacacacagctatccatgtgccaagaccatagttttaatcatgatagctggtggtgaaagcttattcttgttcctcttcaaaattgtttttgttgggtcaggcacagtggctcacgcctgtaatcccaacaccttgggaggctgaggtgggtggatcacctgaggtcaggagttcaagaccagcctggccaacatgatgaaaccccgtctctgctaaaaatacaaaaatagcccggtatggtggcctgtgcttgtaatcccagctacttcggaggctgaggcacaagaatcgctt

SEQ ID NO: 333119 - DNA, 387 bp, Homo sapiens
ataaaacaaaaagagtatgggtaaaatcaaactgcagtaatgaggtctagtaaaataaagacaggaaaatcttgattggatttgacaatatggataaatcattggcaaacttcatcagaaattttagtgataaggaggagtgaaatacagatgacagcgggtaagagtgaatggaaagtgaaaatgtggagatgaactctttcaagaacttgtggctgagaaaggaataagggaactgaaagctaagggtaaaggcagtatttctttaaaaatgggggagaccacagaacattttcatatggaaagagccaggagaatataaaagttttgagattcaagagtaagggagagatggaaagtgatgggatctattgcacaggtggagga

SEQ ID NO: 333120 - DNA, 131 bp, Homo sapiens
ccctggctccagatgaacttaaagggttttacccaatctcattcatacaaacatttttattttactatgttaacattctaatattctttccatgggattctgatccaggatgctaaagtggttagtcgaat

SEQ ID NO: 333121 - DNA, 553 bp, Homo sapiens
tgaggagaaggtatcgagtagctccagtgtactgaactggaggtgtagtcatccattgtagacagaaggcatcaagagatgactgtggactgttcttccatactgtgctgcttgtgaatttatccatgatagaaccagaatataaaaacactgaatcgtgtgatgctaggtaagctgatgcctatgaatactttcatgattcagtttctaactattagtatgagttatataccttacacatagttccaacagatgaattcaattattttgttgtattaaaaaaattgattggggcttaaaatatttttcttaatatgtacattttattctggaattctcatttcatctgtttgtttttggtcagtttagtaaccagatgggataataaagatcctttctttttcttcttcttgaaaaaaaatcgtaacaattaatgtgatattcatgaagtgcttcaaatttcttgagagaatataatgttagtcatttttattcataattatgaataatgaaagcatacttaatattattgaaagcttatcttcagcctaga

SEQ ID NO: 333122 - DNA, 759 bp, Homo sapiens
ctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctgaacccatgtgatgcttcccacttcaaagtgcactaacgccagtcagcttgaaggcatcccctgagctgctggcaaacaaggcctttttacccacagattaacctcttatttgttttaataaatgatcaaaactt

SEQ ID NO: 333123 - DNA, 2063 bp, Homo sapiens
ctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtcaaaaaaaacaaacaccacacaccaccacccaacccaaaaccacacacaccaccaccacacccaacaacgcaaaac

SEQ ID NO: 333124 - DNA, 1757 bp, Homo sapiens
caggtacccgcacccggcaagcagccacggagcccctcgcgcacttgtcctcgatacccttgagttggggctacgcaggccactcctaggccactggctgggcgtccgaacgtgggtcaccccgcgcacagtctagaggttcagaaagatgctgtggcccactttaaaacaaagcccaattattagcgctcggcggctgtttgcgccggtgcagtgtcagatcccccagcgctgcggacaaccagcacccaaaggaagccgagctggagctaaagatcccggctccggagccatctgaccggttttgagacctccagctcgtcgccgtcctggctgcgagagcttgggcacggcgccggggctcagtctcctcttctgtggaatggcgataactgttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtc

SEQ ID NO: 333125 - DNA, 1934 bp, Homo sapiens
ctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtc

SEQ ID NO: 333126 - DNA, 1791 bp, Homo sapiens
ctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctgaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtc

SEQ ID NO: 333127 - DNA, 1338 bp, Homo sapiens
ctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcggtatgtgcttttgtgtgtgtattagccagggttctctagagggacagaattaatagaatatatatatatatatcctatatatatcctatatgattgtgaaagtcaatacttaacacaatcacgatcttgtgatcgtgtaagttaatacttaataaactcccgtgtgtgtgtgtatgtatatatatataaatgcttgtaaacagtaatctgccaaaaataaataagtaaaagaacaagaa

SEQ ID NO: 333128 - DNA, 759 bp, Homo sapiens
caggtacccgcacccggcaagcagccacggagcccctcgcgcacttgtcctcgatacccttgagttggggctacgcaggccactcctaggccactggctgggcgtccgaacgtgggtcaccccgcgcacagtctagaggttcagaaagatgctgtggcccactttaaaacaaagcccaattattagcgctcggcggctgtttgcgccggtgcagtgtcagatcccccagcgctgcggacaaccagcacccaaaggaagccgagctggagctaaagatcccggctccggagccatctgaccggttttgagacctccagctcgtcgccgtcctggctgcgagagcttgggcacggcgccggggctcagtctcctcttctgtggaatggcgataactgttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccaggtataaacttcgacccaagcggatcgaaggttctgaggaaagatggaattcttgttagcaactctctggcagcctttgcttacattagagataggtcaatgaatcaaagcttcctagaaagctgatggatttactaaagtcttgttaataaatgtgctgttcaattat

SEQ ID NO: 333129 - DNA, 282 bp, Homo sapiens
atgacaggcatgagccaccacgcccacctctgtcttttctcttgggattaatgacttccacattagctccaggaataatttctgttaaggtgatgcctggcttgacacttctggtaactcctgctgtttatctattgcttatctccagaacccatgtgatgcttcccacttcaaagtgcactaacgccagtcagcttgaaggcatcccctgagctgctggcaaacaaggcctttttacccacagattaacctcttatttgttttaataaatgatcaaaactt

SEQ ID NO: 333130 - DNA, 970 bp, Homo sapiens
ctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgccaggaagctattaaagggatgtttcaagctgtttctagcacattccaaaataaatgaggagggaagagtc

SEQ ID NO: 333131 - DNA, 1988 bp, Homo sapiens
ctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtc

SEQ ID NO: 333132 - DNA, 1907 bp, Homo sapiens
ctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtc

SEQ ID NO: 333133 - DNA, 1633 bp, Homo sapiens
caggtacccgcacccggcaagcagccacggagcccctcgcgcacttgtcctcgatacccttgagttggggctacgcaggccactcctaggccactggctgggcgtccgaacgtgggtcaccccgcgcacagtctagaggttcagaaagatgctgtggcccactttaaaacaaagcccaattattagcgctcggcggctgtttgcgccggtgcagtgtcagatcccccagcgctgcggacaaccagcacccaaaggaagccgagctggagctaaagatcccggctccggagccatctgaccggttttgagacctccagctcgtcgccgtcctggctgcgagagcttgggcacggcgccggggctcagtctcctcttctgtggaatggcgataactgttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtc

SEQ ID NO: 333134 - DNA, 1535 bp, Homo sapiens
ctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtaatttttatggcttagtaccagcatttctctttaagtaaaggtataaacttcgacccaagcggatcgaaggttctgaggaaagatggaattcttgttagcaactctctggcagcctttgcttacattagagataggtcaatgaatcaaagcttcctagaaagctgatggatttactaaagtcttgttaataaatgtgctgttcaattat

SEQ ID NO: 333135 - DNA, 280 bp, Homo sapiens
  misc_feature (176)..(177): n is a, c, g, or t
  misc_feature (182)..(182): n is a, c, g, or t
  misc_feature (187)..(187): n is a, c, g, or t
  misc_feature (195)..(195): n is a, c, g, or t
  misc_feature (208)..(208): n is a, c, g, or t
  misc_feature (224)..(224): n is a, c, g, or t
gtgtgtacgagtaagaagtgagctcactcatttacaccaaccacccaactatctataaacctagccatggccatccccttatgagcgggcgcagtgattataggctttcgctctaagattaaaaatgccctagcccacttcttaccacaaggcacacctctcctgtgcagcagcgnncagcntcccnattacganatgtcaggaggancaggaagtggtatgcnggggcgccccacaacgtgctcccccgacgtacaccgtatccacatccgcagcgagc

SEQ ID NO: 333136 - DNA, 285 bp, Homo sapiens
accgaagacccctactgtatttcgactgctagaagggagagccctcaaacccctagacggagccgtcctcgggcccctgctcctgtcccccaacccttttctcacccgaagactcactcatttacaccaaccacccaactatctataaacctagccatggccatccccttatgagcgggcgcagtgattataggctttcgctctaagattaaaaatgccctagcccacttcttaccacaaggcacaccccatgctggactccgacggctccttcttcctctacag

SEQ ID NO: 333137 - DNA, 287 bp, Homo sapiens
catttatcctgctatgtcatcgcagatccaaatacgaccatgttttccataccaccaccaaagggcccctccattcctcccattttatttattccaaatcctagccatggccatccccttatgagcgggcgcagtgattataggctttcgctctaagattaaaaatgccctagcccacttcttaccacatgacccaccataattacccccatactccttacactattcctcatcacccaactaaaaatattaaatacaaattaccacctacctccctcaccaaagcc

SEQ ID NO: 333138 - DNA, 309 bp, Homo sapiens
aaaatcgctcattgcatactcttcaatcagccacatagccctcgtagtaacagccattctcatccaaaccccctgaggcttcaccggcgcagtcattctcataatcgcccacggacttacatcctcattactattctgcctagcaaacattattataataaacaccctcaccactacaatcttcctaggaacaacatatgacgcactctcccctgaactctacacaacatatttttgttcctatgaagattgtagtggtgagggttgtttattataataatgttttgtgaattcggctatgaatgatag

SEQ ID NO: 333139 - DNA, 773 bp, Homo sapiens
ggaggtaggtggtagtttgtgtttaatatttttatttgggtgatgaggaatagtgtaaggagtatgggggtaattatggtgggccatacggtagtatttagttggggcatttttaatcttatgagcgggcgcagtgattataggctttcgctctaagattaaaaatgccctagcccacttctagcccacttcttaccacaaggcacacctgcaccccttatccccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333140 - DNA, 1191 bp, Homo sapiens
  misc_feature (47)..(47): n is a, c, g, or t
cactcatttacaccaaccacccaactatctataaacctagccatggncatcctcctactcctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttctactatgaacccccctccccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaagggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333141 - DNA, 957 bp, Homo sapiens
gaccaactcatacacctcctatgaaaaaacttcctaccactcaccctagcattacttatatgatatgtctccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaagggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333142 - DNA, 1277 bp, Homo sapiens
  misc_feature (47)..(47): n is a, c, g, or t
cactcatttacaccaaccacccaactatctataaacctagccatggncatcctcctactcctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttctactatgaacccccctccccatacccaaccccctggtcaacctcaacctaggcctcctatttattctagccacctctagcctagccgtttactcaagtctccttcattgattcgagggatgagtcagtcgaagctcaatagcgtagcgcccggatgcggcgtcacctgtcgagcgagtgtaggcccagaaacaagtgcgtcatagtgaaaggtcatgcctagcccagtcgagttctactattcaaccagttacgtaataaggtggtctcctggttaagctgcgtcgccaccgcttgatcacgagacagcagaggagacagcgctgctgagttcactgcctgccgattcgatgacgcctttgggcccagtgagatatcgatttatctaccggcagctacgcagtagacgcaagccgaaacccccttgcgaggcttgccgacaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333143 - DNA, 844 bp, Homo sapiens
ctattatgtttaataagtatgaagtttaaaatattttaaaatatgaatgaaacccacctctaaactctctataaggatctattccagaatttatacaaattgttcattttttcttattgaacttgtattaagccaagggtcagcaactatgccttcaagcccaatccaacccccacctccatttttataaatgaagttttactggaagacagccactattcatttatgtattatctatggttatttgtaggccacactagcagagaccaaccgaacccccttcgaccttgccgaagggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333144 - DNA, 449 bp, Homo sapiens
tctgaggatcactcaggactgaagcctaacggacaccacatgacacctccagaccggccagccgctccacctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333145 - DNA, 424 bp, Homo sapiens
ctcggccccaattatgctgcgtacagtgaataaggcatttacacactcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333146 - DNA, 603 bp, Homo sapiens
aggtcgctctacgacgatccctctactcgcgggtgctcgcggatatctgttactccctgaacacacctccaagccttccttctggctgctcctgtctggaagattccttttgaccctcaaatatcaactcaacagcgttctgttttctaccactgtcatggttctcccaggcagagttaggtcttcttttttttgaattcccaggcacccgtcgtactcgcgggctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333147 - DNA, 495 bp, Homo sapiens
  misc_feature (47)..(47): n is a, c, g, or t
cactcatttacaccaaccacccaactatctataaacctagccatggncatccttatgagcgggcgcagtgattataggctttcgctctaagattaaaaatgccctagcccacttctctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333148 - DNA, 474 bp, Homo sapiens
ataataactagtatggggataaggggtgtaggtgtgccttgtggtaagaagtgggctagggcatttttaatcttagagcgaaagcctataatcacctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333149 - DNA, 471 bp, Homo sapiens
atacacggatccccgtgggacatatttacccccacctccaagacgatctcatcatacaaccgagctacatcaccacccaagcaatgactaatctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333150 - DNA, 443 bp, Homo sapiens
gtgctctagagtatcccactagtccacggttggctaaaacccaccacaaccaagatggcaatgactcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333151 - DNA, 591 bp, Homo sapiens
  misc_feature (584)..(584): n is a, c, g, or t
ggaggtaggtggtagtttgtgtttaatatttttatttgggtgatgaggaatagtgtaaggagtatgggggtaattatggtgggccatacggtagtatttagttggggcatttttaatcttatgagcgggcgcagtgattataggctttcgctctaagattaaaaatgccctagcccacttctagcccacttcttaccacaaggcacacctgcaccccttatccccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacaccacctccaaatatctcatcaacaaccgattaatacccgcacaagctgaagagggntactcta

SEQ ID NO: 333152 - DNA, 555 bp, Homo sapiens
ggaggtaggtggtagtttgtgtttaatatttttatttgggtgatgaggaatagtgtaaggagtatgggggtaattatggtgggccatacggtagtatttagttggggcatttttaatcttatgagcgggcgcagtgattataggctttcgctctaagattaaaaatgccctagcccacttctagcccacttcttaccacaaggcacacctgcaccccttatccccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacggagattgtaagcggagtgttcatcg

SEQ ID NO: 333153 - DNA, 580 bp, Homo sapiens
  misc_feature (580)..(580): n is a, c, g, or t
ggaggtaggtggtagtttgtgtttaatatttttatttgggtgatgaggaatagtgtaaggagtatgggggtaattatggtgggccatacggtagtatttagttggggcatttttaatcttatgagcgggcgcagtgattataggctttcgctctaagattaaaaatgccctagcccacttctagcccacttcttaccacaaggcacacctgcaccccttatccccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacgagcgggcgcagtgatataggctttcgctctaagattaaaaatccctaggn

SEQ ID NO: 333154 - DNA, 569 bp, Homo sapiens
ggaggtaggtggtagtttgtgtttaatatttttatttgggtgatgaggaatagtgtaaggagtatgggggtaattatggtgggccatacggtagtatttagttggggcatttttaatcttatgagcgggcgcagtgattataggctttcgctctaagattaaaaatgccctagcccacttctagcccacttcttaccacaaggcacacctgcaccccttatccccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacaggctcacaaggagctcggatcctcagaatgaccgcaggc

SEQ ID NO: 333155 - DNA, 560 bp, Homo sapiens
ggaggtaggtggtagtttgtgtttaatatttttatttgggtgatgaggaatagtgtaaggagtatgggggtaattatggtgggccatacggtagtatttagttggggcatttttaatcttatgagcgggcgcagtgattataggctttcgctctaagattaaaaatgccctagcccacttctagcccacttcttaccacaaggcacacctgcaccccttatccccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacggccccagtcccgagagtaggtccgagcgta

SEQ ID NO: 333156 - DNA, 563 bp, Homo sapiens
ggaggtaggtggtagtttgtgtttaatatttttatttgggtgatgaggaatagtgtaaggagtatgggggtaattatggtgggccatacggtagtatttagttggggcatttttaatcttatgagcgggcgcagtgattataggctttcgctctaagattaaaaatgccctagcccacttctagcccacttcttaccacaaggcacacctgcaccccttatccccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacactggccactttcctcgtaaggtcggagatgtcacg

SEQ ID NO: 333157 - DNA, 817 bp, Homo sapiens
ggaggtaggtggtagtttgtgtttaatatttttatttgggtgatgaggaatagtgtaaggagtatgggggtaattatggtgggccatacggtagtatttagttggggcatttttaatcttatgagcgggcgcagtgattataggctttcgctctaagattaaaaatgccctagcccacttctagcccacttcttaccacaaggcacacctgcaccccttatccccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacaccataaggggatggccatggactaggtttatagatagttgggtggttggtgtaaatgagtgaggcaggagtccgaggaggttagttgtggcaataaaaatgattaaggatactagtataagagatcaggttcgtcctttagtgttgtgtatggttatcatttgttttgaggttagtttgattagtcattgttgggtggtgattagtcggttgttgatgagatatttgtatggtggggatcaatagagggggagatagagtcgagcggctcgttaatttagtagtagtag

SEQ ID NO: 333158 - DNA, 563 bp, Homo sapiens
ggaggtaggtggtagtttgtgtttaatatttttatttgggtgatgaggaatagtgtaaggagtatgggggtaattatggtgggccatacggtagtatttagttggggcatttttaatcttatgagcgggcgcagtgattataggctttcgctctaagattaaaaatgccctagcccacttctagcccacttcttaccacaaggcacacctgcaccccttatccccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacataccataaggtcggagtaagtcggagataatcg

SEQ ID NO: 333159 - DNA, 1157 bp, Homo sapiens
  misc_feature (47)..(47): n is a, c, g, or t
cactcatttacaccaaccacccaactatctataaacctagccatggncatcctcctactcctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttctactatgaacccccctccccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaagggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttctcactcatttacaccaaccacccaactatctataaacctagccatggccatccccttatgagcgggcgcagtgattataggctttcgcatagttgggtggttggtgtaaatgagtgaggcaggagtccgaggaggttagttgtggcaataaaaatgattaaggatactagtataagagatcaggttcgtcctttagtgttgtgtatggttatcatttgttttgaggttagtttgattagtcattgttgggtggtgattagtcggttgttgatgagatatttgtatggtggggatcaatagagggggagatagagtcgagcggctcgttaatttagtagtagtag

SEQ ID NO: 333160 - DNA, 727 bp, Homo sapiens
ggaggtaggtggtagtttgtgtttaatatttttatttgggtgatgaggaatagtgtaaggagtatgggggtaattatggtgggccatacggtagtatttagttggggcatttttaatcttatgagcgggcgcagtgattataggctttcgctctaagattaaaaatgccctagcccacttctagcccacttcttaccacaaggcacacctgcaccccttatccccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgcctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333161 - DNA, 339 bp, Homo sapiens
gaccaactcatacacctcctatgaaaaaacttcctaccactcaccctagcattacttatatgatatgtctccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctacgaccaactcatacacctcctatgaaaaaacttcctaccactcaccctagcattacttatatgatatgtctccatacccattacaat

SEQ ID NO: 333162 - DNA, 346 bp, Homo sapiens
ggtcgtcacagtcgcttgtatagtaagatacctctgtacggactccacttatgactccctaaagcccagtgtcgaagcccccatcgcgtgggtcaatagtacttgccgcagtactcttaaaactaggcggctatggtataatacgcctcacactcattctcatctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaat

SEQ ID NO: 333163 - DNA, 319 bp, Homo sapiens
  misc_feature (59)..(59): n is a, c, g, or t
tgccatagcaaccccctgacaaaacacatagcccaccccttccttgtactatccctatnaggcataattataacaagctccatctgcctacgacaaacagacctaaaatcgctcattgcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgtttttac

SEQ ID NO: 333164 - DNA, 1112 bp, Homo sapiens
  misc_feature (47)..(47): n is a, c, g, or t
cactcatttacaccaaccacccaactatctataaacctagccatggncatcctcctactcctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttctactatgaacccccctccccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaagggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttaagagctcaagtgactagtaggtctcctgccatttccacgaagtgactcttcaagcccttggagaagacgaaacaacattagaatctgtgattgcagtggaaagtttactgcatgggtaaaaatggagttgcgttgcgtgacatgtggtccacaacttgaggtatcgtcaacgg

SEQ ID NO: 333165 - DNA, 253 bp, Homo sapiens
ttagatttgaccttcagcaaggtcaaggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcataccccc

SEQ ID NO: 333166 - DNA, 1548 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333167 - DNA, 1458 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgt

SEQ ID NO: 333168 - DNA, 809 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacaaaaaaaagtcgacgcggccgcgaatttagtagta

SEQ ID NO: 333169 - DNA, 803 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccggtgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagac

SEQ ID NO: 333170 - DNA, 786 bp, Homo sapiens
aataatgaaggggattaaatatgtgacattttagtatgttgactgtattatacactgctactaaggaattgaagccgatgtataaacattgtgtctacacattatactattttatgattattgtatggaactttataatacaaaatttctttgcagtacaattttgagaaataggttaactctattttaacttaaaagtaccctaaaaattatttaattgtttattagtgagtaacaggctcaaatacagcagttttttttttcttttagtattgctttgcatcctctaggcttgaatggtataaacactgtgttttgacttcttattcaattttagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagac

SEQ ID NO: 333171 - DNA, 712 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagac

SEQ ID NO: 333172 - DNA, 935 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccggtgggtcattgacagcggtgctgtttctgactggaacgtgggccggtccccagacccaagagctgtgagctgcctaagaaatcatggcattcacacagcccataaagcaagacaggtagacaagctcttgttcaatttctaatatatagagtccagtaacttgagaagtagcgaaaggattaaccagacttgtatattaatgaatgtgtttatttagggtgagcttaaccagctatggtgtgtccattttgtttcacttctggttgcacggtgttgaaagacttgcctgactttggaatttacttattaaaatgcacataaaagctaggtaatttataatgagagagcctgactgtgagctggggctgagcggtgctctgtcttctgttccttcctgcataatttttattaaacatttaggccatagtaatcatcctgctgatattgcaagtttgttgctagaatgaggttatataatatatacaaaaacattttttcaactgtaaagtgccttagtaatatagggtaataccagcaacattatggatatataattatagtctattgggccacacttaagtttggagtctaataaagtcacaatcaaattctgcaatttcaattgaagataaccttgtctttatattatgaattagaagctaaagttgatttttctaagagttctttatttaaatg

SEQ ID NO: 333173 - DNA, 497 bp, Homo sapiens
gttgtatttcattttaaaataagctggttgcaacccacttcattttcgtgattcactcctggatcattagtagcaactctttaaacaataatttttgttgaaattgtttttctgatatctttgtcatctgtacttggagtacttggctggttggtgtcaaatcactgaacttgagcctgataggctgttctccagcagggtctaccctcactggttggacaaaggcgtcaaaggatagtgttggcctttgtttttcctgagggatagcacagcccccgtgtgtcaggtgtgtaaagaaggggagctggcatgtgcccttccatccaacctaaccctgtttccccacccctccctttttttaaaggtaacatttgtcgatcacccattgcagaagcagttttcaggaaacttgtaaccgatcaaaacatctcagagaatgtaagtaccattcattatcttaaagaggccaacctgaactcctctgggcaggaaattgc

SEQ ID NO: 333174 - DNA, 1548 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333175 - DNA, 1488 bp, Homo sapiens
tcgaattcccgcgcagagcccgcaagtccgtgctgtttgtgtgtctgggtaacatttgtcgatcacccattgcagaagcagttttcaggaaacttgtaaccgatcaaaacatctcagagaattggagggtagacagcgcggcaacttccggtgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333176 - DNA, 2170 bp, Homo sapiens
attttttaatttttatttttcagtccttattctgttctcattgtttttgctgacaccatagcccataggcatcgtaaaaacacctttttaggagaccccatttgctttgactggcactgagcaccgtgtttctttgcgtgtggggcaagtggagttcctgcagcctcacatttgcacgtgctgttcctctgcctggaagctcctccttgcttcttgggtcattcggctcctatttgcccctcgtgggtcagcttaaattcatttcttgatagaggtattctgctgccctgtcattaggccagattgtgcattagacttaggcctgcctgcagttctcattcctgcacctaatcctgagctgtaaaacttcgtgcatgggagctcttggctgttccgttcccacataaagcacgtacctgactcatcaactcatctgtcgcaggtgctcagtcgaaatttgttaaataaatggaggcgcttagttaagtttgcctttttcttttgtagcaatgtgaaagctaagggtggaagtctagagtgaagctgagttttcagcttgggcagaggcttaaggaataaaagatggaagagtaattaaggagtgggtcgtgctgtgggaagtgctgtgtcaagacacctgaggatggaattggtagccctctgttttgggactggttcagatggtgttttgggttcctttctatgacctttatctctgaaacttgattgtcttaaaatgtattttgtgggagaaaatataattattgtatattttgtgtaacagaatcagtgagaataagctgctgtcgcaaactgtcttgcctagagagagggcagtggcatacagctgcagaaggggccacacgggcctgctgagtgttccgtttcatttcaaattaggtcattctgtcttgattttgatatggatgtttcagaagaccctagcagatgtccctgtttaacttgaaaccatagatcagaaaactaagttcatatttcaattttacagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333177 - DNA, 1560 bp, Homo sapiens
aataatgaaggggattaaatatgtgacattttagtatgttgactgtattatacactgctactaaggaattgaagccgatgtataaacattgtgtctacacattatactattttatgattattgtatggaactttataatacaaaatttctttgcagtacaattttgagaaataggttaactctattttaacttaaaagtaccctaaaaattatttaattgtttattagtgagtaacaggctcaaatacagcagttttttttttcttttagtattgctttgcatcctctaggcttgaatggtataaacactgtgttttgacttcttattcaattttagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333178 - DNA, 1486 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333179 - DNA, 2311 bp, Homo sapiens
attttttaatttttatttttcagtccttattctgttctcattgtttttgctgacaccatagcccataggcatcgtaaaaacacctttttaggagaccccatttgctttgactggcactgagcaccgtgtttctttgcgtgtggggcaagtggagttcctgcagcctcacatttgcacgtgctgttcctctgcctggaagctcctccttgcttcttgggtcattcggctcctatttgcccctcgtgggtcagcttaaattcatttcttgatagaggtattctgctgccctgtcattaggccagattgtgcattagacttaggcctgcctgcagttctcattcctgcacctaatcctgagctgtaaaacttcgtgcatgggagctcttggctgttccgttcccacataaagcacgtacctgactcatcaactcatctgtcgcaggtgctcagtcgaaatttgttaaataaatggaggcgcttagttaagtttgcctttttcttttgtagcaatgtgaaagctaagggtggaagtctagagtgaagctgagttttcagcttgggcagaggcttaaggaataaaagatggaagagtaattaaggagtgggtcgtgctgtgggaagtgctgtgtcaagacacctgaggatggaattggtagccctctgttttgggactggttcagatggtgttttgggttcctttctatgacctttatctctgaaacttgattgtcttaaaatgtattttgtgggagaaaatataattattgtatattttgtgtaacagaatcagtgagaataagctgctgtcgcaaactgtcttgcctagagagagggcagtggcatacagctgcagaaggggccacacgggcctgctgagtgttccgtttcatttcaaattaggtcattctgtcttgattttgatatggatgtttcagaagaccctagcagatgtccctgtttaacttgaaaccatagatcagaaaactaagttcatatttcaattttacagagatttgaatagaaaaagtaatcaagttaaaacctgcaaagctaaaattgaactacttgggagctatgatccacaaaaacaacttattattgaagatccctattatgtaagtacagttcacgttttagggctaatatgaagacccaacacatttgtatcctgccatattaaataacagatgagattgtgttaaggatgtttttgttatgcaggttttgccattttcttctttttcctgtccatttaggggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333180 - DNA, 1458 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgt

SEQ ID NO: 333181 - DNA, 453 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagac

SEQ ID NO: 333182 - DNA, 1459 bp, Homo sapiens
tcgaattcccgcgcagagcccgcaagtccgtgctgtttgtgtgtctgggtaacatttgtcgatcacccattgcagaagcagttttcaggaaacttgtaaccgatcaaaacatctcagagaattgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333183 - DNA, 774 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagac

SEQ ID NO: 333184 - DNA, 774 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagac

SEQ ID NO: 333185 - DNA, 820 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgaggtaatcctgtttttgaagaatatttctgttcaactctcagttcagcagtgggccaagtaatttgttgtccagatttactttttctattttaaaggttttaatagtcagtgatggtcaccatatgtagaattattttatttagaacagcaaaaaacttagtaatctagaattgtctcttaggtatttacaaggaaatacaccttagaaaagggaaagtctagttgttaatagcatgatttaattggaaaactagcttggctgttatagttttgtatcaagcatattgttctgcatgagaacgattttgatatttttgctgtaatgattcctgggcagggcagtgttttattgattctcaggtcaaagctctgcaaccataggttcctattattatcccatcttgtaaaagaaggaagtgagaaacggtaatgtt

SEQ ID NO: 333186 - DNA, 1682 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatataaatctggtgtctgcctgtttttttattgacaggtaaggaagcatttgaaaacattgtattgtcctttttacatgatctgtgatgttaggtgtgcatattttatcttcaggataaggaagtaaaatgatgaaaat

SEQ ID NO: 333187 - DNA, 1425 bp, Homo sapiens
gaattcccccgcgcgcagagaggccgcgagacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333188 - DNA, 1577 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccggtgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333189 - DNA, 1689 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgtaagtacagttcacgttttagggctaatatgaagacccaacacatttgtatcctgccatattaaataacagatgagattgtgttaaggatgtttttgttatgcaggttttgccattttcttctttttcctgtccatttaggggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333190 - DNA, 1494 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatata

SEQ ID NO: 333191 - DNA, 786 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaagtgcttgttgttgacagatgttaactttctgtaaaataaactgtatttgcaaatcgcg

SEQ ID NO: 333192 - DNA, 915 bp, Homo sapiens
tgcgcaggcgcgcggggcaagaggctggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgtaagtacagttcacgttttagggctaatatgaagacccaacacatttgtatcctgccatattaaataacagatgagattgtgttaaggatgtttttgttatgcaggttttgccattttcttctttttcctgtccatttaggggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagac

SEQ ID NO: 333193 - DNA, 537 bp, Homo sapiens
tctgagtataaccagaaccaactgagccacccaaagtccgtggggtgccaggggtgtgggaacccatcaggacccacggtcaccatcttgattgcacatgagaaccacctgggactttacaaaatgtcaatgatcaccccataccaatgagacagaatccttatgcagggggcccagagaaacagtattttattttttcaaagagctctccagccagggttgagaaccgcagatccttctagcccagccctaaaattttttagctgctgaactaaggctgagcatctgcttaagatcatgagcaagagggcagaagtacccgcaacgtaaacatgaaaaaaaggactttgccatttggttgtgaagtcctggcttctcggttcactcgctgtgtgaccttggacaagtcacttagcctctctgagcctgagctattaaaatgaaatcatagatataaatcacccagcatgttcctggtacccagcaggccctcaataaatatttgtttctatctctttctctctaggatctaaggct

SEQ ID NO: 333194 - DNA, 371 bp, Homo sapiens
agaatggtaggggactgaattttgtaagcagtgtgtctttcctgacaggggcagggagcctggcttcctgagactgtcccctgatgccacagcagatgtgtcaaaccatttttcctgctcatggcatgtagtttgagagagcttgatagtgaagctgccagctcagctgtgactggccactcatttgcagacaagaatgccttactggcctgggcttgcttaaggtaattgcttctagactcctcactcctgctgggccacagttgcttgaacagtcaaataaggggttggggggtagaggatatatctcaaaaccttctttgtgcttgaagatttgtgattccttgttctttggagaatgaaaatatctt

SEQ ID NO: 333195 - DNA, 491 bp, Homo sapiens
tggggatcagttagggggaatggggagctttcacttctctgaagccaactgtgatcagcattgccctgagagtcactcttgggtcagacaataagaaagacaatgaggatggagtgggaaacaggatgggaaggaaagacaagaatgaatgcacaaaaacaaggcaacaagttagagtaaaaagaaagtgaatagcaacaaacatcatgtcatatttcaccctcactcactgctgctggtggctccaaagggagtttttaagtgtctcagctccagccagacttgtcttcatttactcttgcttctgaccatggcttctgaccatggctgccacatgatttgccttttacttagcaagcccagaggagttgcagcagtgccaggatgaagaactgcattctctcagtggaaggtggctgggtactatttgtattgagtgaattattcactcttgaaggcaagcactcccatccagattcatacactgcaat

SEQ ID NO: 333196 - DNA, 283 bp, Homo sapiens
cgattctcctgcctcagcctcctgagtagctgggattacgggcacccgcaaccacgcccggctaatttttgtatttttagtagagaccgggtttcaccgtgttggccaggctggtctcgaactcccgacctcagatgatctgcccacttcggcctcccagagtgctgggattacaggtgtgagccacgggtctggcctaaacacagctttattaaggtataacttgcgtgcttaccatataactcacccgttatatatttttgtttttattaatttttttttt

SEQ ID NO: 333197 - DNA, 2102 bp, Homo sapiens
tactgtacatttccatcagggcacttaaaagttctgttatttttgtttggttttgttatttcagtcctcagttaaggcaagaatgcatgtgtttcttaagaatgagtactctgcgttgatgtttatgagaaggtggtcattagatgcagtcttttcctttttaatcccctcttagcacttctgtgagtggagaggacattaagtaaaatttggaatcataagttgcaatgcagtaaaatggtgctggggaaggagccagttagtgtttctgtgagtttgtgttgtgatgcaataagagataagtaatgcagagagaaatgaaccatggaaagtaagaacactgatggtgattcctctgcaaagatgataagaaaaagaaccaataaatcacacaatctttatgtgctttctatatgtatttcttagtagtgataccattgatcctcttactttttttactccattaatactaataattatatactttgctgaggatcaaaacagccaagaaaggaattactgctaaagcatctaagattctcctgaactgtaaaatcaacaggaaatggccactgggagagaaggatttggtattgggtgaggggctttctccctttacctgcctcttcttgcttgctaatagtaagttctttgtgcaccttccaccacttctgagccactactattcaagtagagatttgccccaacacattaactttttccttggagatttatatggtcctgcattttgtcctgtgctcacaatgtgaagtgtcttctgtattcaaatcaaaaaataatatatttaaggtatataagtgtgaatctcctataatgatggaagaagaggttctcttgtcttagatagaaaagagccttctccaagagcaatgtcaaaacttgggctgtcatctttgagctgtttaccaaaatacagaccattattgaagaaaaacaaattatctattttgttttcccccatctaacatgatagtgcccccaaccaggttgtagcattgccttttaaaagagactcactcactcttagtttttaagaactggaaatttcccatcctcagatcccttaaaggatgaagagttggctgtacacttagcggacttgcctcttgtatgcaaggactactgattgaagtctgttttgctgtgtctggttatgttgtctgcacttttatgaaatcactacaataggtctgcattggaaatgactattaatttgtaaagaagtaagttttattaaacactgtctagaaaaagaaagtgaagctgagaactcttcctttattgtgcatttatattttctgctgaattccggtagttccctttaaagtcatgttgactaatgttttcctccttgtttgtattcagatttccaaaatttcactcatacaagggaagagactccatttagcttaacggtagtctttagatcataagaaatatataaattagtatgcaccttatctgcctgttgtgggtttcttaaacttgcacttcctacccacccaaagatagatatcctttaaagaaaataaaggcagagaattaaaactggggagccatttactatgtcaccatcactgttaactgtttcccagcaatctaaactttttgaagtttcagaggtgtattttttttttgtatatatgtctgtgtgattgtattgttttgtttctaaatatacaaggaattctttaaatagagaaaaaggttaatcctcactgaaacaccaggatgcccactggatatactaatctgaacatctgtaggtagtttgtcatgaaaaagtggagagaagatgagacttttgaatgaatgaaaaagggtatcttgatacccagaattccccccaaagtacgggtaattcaacctgcacagttttctttcactcaaagtgttcagcacttgtgagtgaaaaatcatgtaattatctgtaaatatgtagctaacaaattgacctagtttctgtatttttttgtttttgtactaaagtttataggtctgtgccagctagagagaagttgctgtcattaccagttgtggtcctagcatctaaccctgaaaccatcctaggtgacattttt

SEQ ID NO: 333198 - DNA, 2579 bp, Homo sapiens
tagtacgaggccggtggtaatcggccgagggcagtgagagagggagcccgtcctcggggggtaaccctctctctggggtggccagcagctccccgaacctcccgcacagagacgccgccgtggcggggagctcgcccaggctgcccagcctgctgcccccgcgcccaccgcctgccctgagcctggacatcgcctccgactccctgaggacagcaaacaaggtcgactcggatcttgcagactacaagctccgcgcgcagccgctcctggtgcgggcccacagcagcctgggccccggccggccgcggagccccctggcctgcgacgactgttcccttcgctcggccaaatcctccttcagcctcctggcgcccatccgcagcaaggacgtccgcagcaggagttacctggagggcagcctcctggccagcggggccctgttgggggcggatgagctggcccgctacttcccagaccggaacgtggcactcttcgtggccacctggaacatgcagggccagaaggagctcccgcccagcctggacgagttcctgctcccagccgaggccgactatgcccaggacctgtatgtcatcggggtccaggagggctgttctgacaggcgggagtgggagactcgtctgcaggagacgctgggcccgcactatgtgctgctgtcctcggcggcccacggcgtgctctacatgtcgctcttcatccgcagggacctcatctggttctgctcagaggtggagtgctccacggtgaccacacgcatcgtgtctcagatcaagaccaagggggccttgggcatcagcttcaccttttttggcacttccttcctcttcatcacgtcccacttcacctcaggtgacgggaaggtggcggagcggctgctggactacaccaggactgtacaagccctggtcctgcccagaaatgtgcccgacaccaacccctatcgctccagcgcagcggacgtcaccacccgcttcgatgaggtgttctggtttggagacttcaacttccgcctgagtggcgggcgcacagtcgtggacgccctcctgtgccagggcctggtggtggacgtgccggcgctgctgcagcacgaccagctcatccgggagatgcggaaagggtccatcttcaagggcttccaggagccggacatccacttcctcccatcatacaagtttgacatcgggaaggacacgtacgacagcacctccaagcagaggacgccctcatacacggaccgcgtcttgtacagaagccgccacaagggtgacatctgtcctgtgagctactcttcctgccccgggatcaagacgtccgaccaccgccctgtgtatggcctcttccgggtgaaagtgaggccggggcgagacaacattccgttggcagctggcaaatttgatagagaactgtacttactaggaattaaaagacggatttcgaaggagattcagaggcagcaagcactacagagtcagaactccagcaccatctgctccgtttcttgaagtttgctgaacgaggactcacagctgcaacgtggggtgattgtattgatcaaaacccactgggaaggacaaagagtttgccgcctttcggggatccgagggactgtggcgaccgtgcctctgtgccagcgtcccaggaaggaagccaaccctgagcgagcctgtcctctgtggcaggtccacacggtgtgggtgggcagggcttggacccccgtctccatggcaggtccatacagcatgggtggcagggtttggacccgcccagcagcaccacggaccccagccactctcgggggcagacgtcagaatccgttcctgagcagctcctgtgccctgggggcagtcacagagccccccaacacccccgtgctctgcaccagcctctccctccacacccgaagcaggcgtccatctgtgtcctcctggcagcccctcaaacacacaccaccccatgtcacacgggtatccagagcaaggctggatctgggctaggtgacccctggggcctcagacctctgagtgggccccagagcccagctgaggaagccacacagcctccaggacgtggcacggttcccctccacttggctgcaagtcgcctgccatggggcgaggaggcctgcaccccagtataagggcctccccagctgagtaagaagctgcttcccctcctctcataggccaagcctattgtgtgaaaccatctcatggtcttggtgacgtagaccatttttgaaaccgtctcatggtcttggtgacgtagaccgtttgcttctttaactccagccgcggaatgacattagtggaaccgggctagggaactgctggaagttcaggatgccaccaccttgaacacctaggccagggatccccaccatgtcccgggtttctttcttcgagagtatagaaccgttcattcttgctttgtgtcccattccatctcttgaaaaaatgtagtctttgaatgtgtgaaaatctagggacattcaatctagtcttttaaattatttttccatatttatatttttaaataaatgcatatattgagtcttaaaa

SEQ ID NO: 333199 - DNA, 2532 bp, Homo sapiens
tagtacgaggccggtggtaatcggccgagggcagtgagagagggagcccgtcctcggggggtaaccctctctctggggtggccagcagctccccgaacctcccgcacagagacgccgccgtggcggggagctcgcccaggctgcccagcctgctgcccccgcgcccaccgcctgccctgagcctggacatcgcctccgactccctgaggacagcaaacaaggtcgactcggatcttgcagactacaagctccgcgcgcagccgctcctggtgcgggcccacagcagcctgggccccggccggccgcggagccccctggcctgcgacgactgttcccttcgctcggccaaatcctccttcagcctcctggcgcccatccgcagcaaggacgtccgcagcaggagttacctggagggcagcctcctggccagcggggccctgttgggggcggatgagctggcccgctacttcccagaccggaacgtggcactcttcgtggccacctggaacatgcagggccagaaggagctcccgcccagcctggacgagttcctgctcccagccgaggccgactatgcccaggacctgtatgtcatcggggtccaggagggctgttctgacaggcgggagtgggagactcgtctgcaggagacgctgggcccgcactatgtgctgctgtcctcggcggcccacggcgtgctctacatgtcgctcttcatccgcagggacctcatctggttctgctcagaggtggagtgctccacggtgaccacacgcatcgtgtctcagatcaagaccaagggggccttgggcatcagcttcaccttttttggcacttccttcctcttcatcacgtcccacttcacctcaggtgacgggaaggtggcggagcggctgctggactacaccaggactgtacaagccctggtcctgcccagaaatgtgcccgacaccaacccctatcgctccagcgcagcggacgtcaccacccgcttcgatgaggtgttctggtttggagacttcaacttccgcctgagtggcgggcgcacagtcgtggacgccctcctgtgccagggcctggtggtggacgtgccggcgctgctgcagcacgaccagctcatccgggagatgcggaaagggtccatcttcaagggcttccaggagccggacatccacttcctcccatcatacaagtttgacatcgggaaggacacgtacgacagcacctccaagcagaggacgccctcatacacggaccgcgtcttgtacagaagccgccacaagggtgacatctgtcctgtgagctactcttcctgccccgggatcaagacgtccgaccaccgccctgtgtatggcctcttccgggtgaaagtgaggccggggcgagacaagaattaaaagacggatttcgaaggagattcagaggcagcaagcactacagagtcagaactccagcaccatctgctccgtttcttgaagtttgctgaacgaggactcacagctgcaacgtggggtgattgtattgatcaaaacccactgggaaggacaaagagtttgccgcctttcggggatccgagggactgtggcgaccgtgcctctgtgccagcgtcccaggaaggaagccaaccctgagcgagcctgtcctctgtggcaggtccacacggtgtgggtgggcagggcttggacccccgtctccatggcaggtccatacagcatgggtggcagggtttggacccgcccagcagcaccacggaccccagccactctcgggggcagacgtcagaatccgttcctgagcagctcctgtgccctgggggcagtcacagagccccccaacacccccgtgctctgcaccagcctctccctccacacccgaagcaggcgtccatctgtgtcctcctggcagcccctcaaacacacaccaccccatgtcacacgggtatccagagcaaggctggatctgggctaggtgacccctggggcctcagacctctgagtgggccccagagcccagctgaggaagccacacagcctccaggacgtggcacggttcccctccacttggctgcaagtcgcctgccatggggcgaggaggcctgcaccccagtataagggcctccccagctgagtaagaagctgcttcccctcctctcataggccaagcctattgtgtgaaaccatctcatggtcttggtgacgtagaccatttttgaaaccgtctcatggtcttggtgacgtagaccgtttgcttctttaactccagccgcggaatgacattagtggaaccgggctagggaactgctggaagttcaggatgccaccaccttgaacacctaggccagggatccccaccatgtcccgggtttctttcttcgagagtatagaaccgttcattcttgctttgtgtcccattccatctcttgaaaaaatgtagtctttgaatgtgtgaaaatctagggacattcaatctagtcttttaaattatttttccatatttatatttttaaataaatgcatatattgagtcttaaaa

SEQ ID NO: 333200 - DNA, 2398 bp, Homo sapiens
tagtacgaggccggtggtaatcggccgagggcagtgagagagggagcccgtcctcggggggtaaccctctctctggggtggccagcagctccccgaacctcccgcacagagacgccgccgtggcggggagctcgcccaggctgcccagcctgctgcccccgcgcccaccgcctgccctgagcctggacatcgcctccgactccctgaggacagcaaacaaggtcgactcggatcttgcagactacaagctccgcgcgcagccgctcctggtgcgggcccacagcagcctgggccccggccggccgcggagccccctggcctgcgacgactgttcccttcgctcggccaaatcctccttcagcctcctggcgcccatccgcagcaaggacgtccgcagcaggagttacctggagggcagcctcctggccagcggggccctgttgggggcggatgagctggcccgctacttcccagaccggaacgtggcactcttcgtggccacctggaacatgcagggccagaaggagctcccgcccagcctggacgagttcctgctcccagccgaggccgactatgcccaggacctgtatgtcatcggggtccaggagggctgttctgacaggcgggagtgggagactcgtctgcaggagacgctgggcccgcactatgtgctgctgtcctcggcggcccacggcgtgctctacatgtcgctcttcatccgcagggacctcatctggttctgctcagaggtggagtgctccacggtgaccacacgcatcgtgtctcagatcaagaccaagggggccttgggcatcagcttcaccttttttggcacttccttcctcttcatcacgtcccacttcacctcaggtgacgggaaggtggcggagcggctgctggactacaccaggactgtacaagccctggtcctgcccagaaatgtgcccgacaccaacccctatcgctccagcgcagcggacgtcaccacccgcttcgatgaggtgttctggtttggagacttcaacttccgcctgagtggcgggcgcacagtcgtggacgccctcctgtgccagggcctggtggtggacgtgccggcgctgctgcagcacgaccagctcatccgggagatgcggaaagggtccatcttcaagggcttccaggagccggacatccacttcctcccatcatacaagtttgacatcgggaaggacacgtacgacagcacctccaagcagaggacgccctcatacacggaccgcgtcttgtacagaagccgccacaagggtgacatctgtcctgtgagctactcttcctgccccgggatcaagacgtccgaccaccgccctgtgtatggcctcttccgggtgaaagtgaggccggggcgagacaacattccgttggcagctggcaaatttgatagagaactgtacttactaggaattaaaagacggatttcgaaggagattcagaggcagcaagcactacagagtcagaactccagcaccatctgctccgtttcttgaagtttgctgaacgaggactcacagctgcaacgtggggtgattgtattgatcaaaacccactgggaaggacaaagagtttgccgcctttcggggatccgagggactgtggcgaccgtgcctctgtgccagcgtcccaggaaggaagccaaccctgagcgagcctgtcctctgtggcaggtccacacggtgtgggtgggcagggcttggacccccgtctccatggcaggtccatacagcatgggtggcagggtttggacccgcccagcagcaccacggaccccagccactctcgggggcagacgtcagaatccgttcctgagcaggcctcagacctctgagtgggccccagagcccagctgaggaagccacacagcctccaggacgtggcacggttcccctccacttggctgcaagtcgcctgccatggggcgaggaggcctgcaccccagtataagggcctccccagctgagtaagaagctgcttcccctcctctcataggccaagcctattgtgtgaaaccatctcatggtcttggtgacgtagaccatttttgaaaccgtctcatggtcttggtgacgtagaccgtttgcttctttaactccagccgcggaatgacattagtggaaccgggctagggaactgctggaagttcaggatgccaccaccttgaacacctaggccagggatccccaccatgtcccgggtttctttcttcgagagtatagaaccgttcattcttgctttgtgtcccattccatctcttgaaaaaatgtagtctttgaatgtgtgaaaatctagggacattcaatctagtcttttaaattatttttccatatttatatttttaaataaatgcatatattgagtcttaaaa

SEQ ID NO: 333201 - DNA, 1663 bp, Homo sapiens
tgccctctgcccgttgcaccctcgctcaccctcctgccaggcccatggctgcatctctgggcatgtcccgatatctggatatctgctggaagcctcaagaagccactgaggcagggcagggtaggagcagccgctgtccacagggtctctccagcggcgagggacaggccctggcccagctggccacagacgccaggcaacaaaatgggcatgagtgtcaggggtcccagaaggcttccttgtggggggcgcttgagaacagcagggaggtgagcgggccacgccccacggctcctcacaagtaactggacctcctgcctctgcaatcttcccaaaggaccgcgtcttgtacagaagccgccacaagggtgacatctgtcctgtgagctactcttcctgccccgggatcaagacgtccgaccaccgccctgtgtatggcctcttccgggtgaaagtgaggccggggcgagacaacattccgttggcagctggcaaatttgatagagaactgtacttactaggaattaaaagacggatttcgaaggagattcagaggcagcaagcactacagagtcagaactccagcaccatctgctccgtttcttgaagtttgctgaacgaggactcacagctgcaacgtggggtgattgtattgatcaaaacccactgggaaggacaaagagtttgccgcctttcggggatccgagggactgtggcgaccgtgcctctgtgccagcgtcccaggaaggaagccaaccctgagcgagcctgtcctctgtggcaggtccacacggtgtgggtgggcagggcttggacccccgtctccatggcaggtccatacagcatgggtggcagggtttggacccgcccagcagcaccacggaccccagccactctcgggggcagacgtcagaatccgttcctgagcagctcctgtgccctgggggcagtcacagagccccccaacacccccgtgctctgcaccagcctctccctccacacccgaagcaggcgtccatctgtgtcctcctggcagcccctcaaacacacaccaccccatgtcacacgggtatccagagcaaggctggatctgggctaggtgacccctggggcctcagacctctgagtgggccccagagcccagctgaggaagccacacagcctccaggacgtggcacggttcccctccacttggctgcaagtcgcctgccatggggcgaggaggcctgcaccccagtataagggcctccccagctgagtaagaagctgcttcccctcctctcataggccaagcctattgtgtgaaaccatctcatggtcttggtgacgtagaccatttttgaaaccgtctcatggtcttggtgacgtagaccgtttgcttctttaactccagccgcggaatgacattagtggaaccgggctagggaactgctggaagttcaggatgccaccaccttgaacacctaggccagggatccccaccatgtcccgggtttctttcttcgagagtatagaaccgttcattcttgctttgtgtcccattccatctcttgaaaaaatgtagtctttgaatgtgtgaaaatctagggacattcaatctagtcttttaaattatttttccatatttatatttttaaataaatgcatatattgagtcttaaaa

SEQ ID NO: 333202 - DNA, 3095 bp, Homo sapiens
ggcgtttctgctcctcgctgcgccggcgaccccggacccggcacccgtgacccctcgcgctgcctgcggcctcgcgccgaggcctgccccgggagagaccgtccatgccgtccaaggcggagaatctgcggccctccgagccggccccgcagccgccggaagggaggacgctccaaggacagcttcccggcgctccgccggcccagcgcgcggggtccccacccgatgctccgggctccgagagccccgcgcttgcctgcagcactccggccacgcccagcggcgaggacccgccagcccgagcagcacccatcgccccgcggccccccgccaggcctcgactggagcgagccctgtccctggacgacaagggctggaggaggaggcgttttcgaggcagccaggaggacctggaagcccggaatgggaccagtccctccaggggctcagtgcagagcgagggccccggggcccccgcccacagctgctccccgccctgcctgagcacctccttgcaggaaatccccaagtcccgcggggtcctgagcagtgagagagggagcccgtcctcggggggtaaccctctctctggggtggccagcagctccccgaacctcccgcacagagacgccgccgtggcggggagctcgcccaggctgcccagcctgctgcccccgcgcccaccgcctgccctgagcctggacatcgcctccgactccctgaggacagcaaacaaggtcgactcggatcttgcagactacaagctccgcgcgcagccgctcctggtgcgggcccacagcagcctgggccccggccggccgcggagccccctggcctgcgacgactgttcccttcgctcggccaaatcctccttcagcctcctggcgcccatccgcagcaaggacgtccgcagcaggagttacctggagggcagcctcctggccagcggggccctgttgggggcggatgagctggcccgctacttcccagaccggaacgtggcactcttcgtggccacctggaacatgcagggccagaaggagctcccgcccagcctggacgagttcctgctcccagccgaggccgactatgcccaggacctgtatgtcatcggggtccaggagggctgttctgacaggcgggagtgggagactcgtctgcaggagacgctgggcccgcactatgtgctgctgtcctcggcggcccacggcgtgctctacatgtcgctcttcatccgcagggacctcatctggttctgctcagaggtggagtgctccacggtgaccacacgcatcgtgtctcagatcaagaccaagggggccttgggcatcagcttcaccttttttggcacttccttcctcttcatcacgtcccacttcacctcaggtgacgggaaggtggcggagcggctgctggactacaccaggactgtacaagccctggtcctgcccagaaatgtgcccgacaccaacccctatcgctccagcgcagcggacgtcaccacccgcttcgatgaggtgttctggtttggagacttcaacttccgcctgagtggcgggcgcacagtcgtggacgccctcctgtgccagggcctggtggtggacgtgccggcgctgctgcagcacgaccagctcatccgggagatgcggaaagggtccatcttcaagggcttccaggagccggacatccacttcctcccatcatacaagtttgacatcgggaaggacacgtacgacagcacctccaagcagaggacgccctcatacacggaccgcgtcttgtacagaagccgccacaagggtgacatctgtcctgtgagctactcttcctgccccgggatcaagacgtccgaccaccgccctgtgtatggcctcttccgggtgaaagtgaggccggggcgagacaacattccgttggcagctggcaaatttgatagagaactgtacttactaggaattaaaagacggatttcgaaggagattcagaggcagcaagcactacagagtcagaactccagcaccatctgctccgtttcttgaagtttgctgaacgaggactcacagctgcaacgtggggtgattgtattgatcaaaacccactgggaaggacaaagagtttgccgcctttcggggatccgagggactgtggcgaccgtgcctctgtgccagcgtcccaggaaggaagccaaccctgagcgagcctgtcctctgtggcaggtccacacggtgtgggtgggcagggcttggacccccgtctccatggcaggtccatacagcatgggtggcagggtttggacccgcccagcagcaccacggaccccagccactctcgggggcagacgtcagaatccgttcctgagcagctcctgtgccctgggggcagtcacagagccccccaacacccccgtgctctgcaccagcctctccctccacacccgaagcaggcgtccatctgtgtcctcctggcagcccctcaaacacacaccaccccatgtcacacgggtatccagagcaaggctggatctgggctaggtgacccctggggcctcagacctctgagtgggccccagagcccagctgaggaagccacacagcctccaggacgtggcacggttcccctccacttggctgcaagtcgcctgccatggggcgaggaggcctgcaccccagtataagggcctccccagctgagtaagaagctgcttcccctcctctcataggccaagcctattgtgtgaaaccatctcatggtcttggtgacgtagaccatttttgaaaccgtctcatggtcttggtgacgtagaccgtttgcttctttaactccagccgcggaatgacattagtggaaccgggctagggaactgctggaagttcaggatgccaccaccttgaacacctaggccagggatccccaccatgtcccgggtttctttcttcgagagtatagaaccgttcattcttgctttgtgtcccattccatctcttgaaaaaatgtagtctttgaatgtgtgaaaatctagggacattcaatctagtcttttaaattatttttccatatttatatttttaaataaatgcatatattgagtcttaaaa

SEQ ID NO: 333203 - DNA, 2477 bp, Homo sapiens
tagtacgaggccggtggtaatcggccgagggcagtgagagagggagcccgtcctcggggggtaaccctctctctggggtggccagcagctccccgaacctcccgcacagagacgccgccgtggcggggagctcgcccaggctgcccagcctgctgcccccgcgcccaccgcctgccctgagcctggacatcgcctccgactccctgaggacagcaaacaaggtcgactcggatcttgcagactacaagctccgcgcgcagccgctcctggtgcgggcccacagcagcctgggccccggccggccgcggagccccctggcctgcgacgactgttcccttcgctcggccaaatcctccttcagcctcctggcgcccatccgcagcaaggacgtccgcagcaggagttacctggagggcagcctcctggccagcggggccctgttgggggcggatgagctggcccgctacttcccagaccggaacgtggcactcttcgtggccacctggaacatgcagggccagaaggagctcccgcccagcctggacgagttcctgctcccagccgaggccgactatgcccaggacctgtatgtcatcggggtccaggagggctgttctgacagggacctcatctggttctgctcagaggtggagtgctccacggtgaccacacgcatcgtgtctcagatcaagaccaagggggccttgggcatcagcttcaccttttttggcacttccttcctcttcatcacgtcccacttcacctcaggtgacgggaaggtggcggagcggctgctggactacaccaggactgtacaagccctggtcctgcccagaaatgtgcccgacaccaacccctatcgctccagcgcagcggacgtcaccacccgcttcgatgaggtgttctggtttggagacttcaacttccgcctgagtggcgggcgcacagtcgtggacgccctcctgtgccagggcctggtggtggacgtgccggcgctgctgcagcacgaccagctcatccgggagatgcggaaagggtccatcttcaagggcttccaggagccggacatccacttcctcccatcatacaagtttgacatcgggaaggacacgtacgacagcacctccaagcagaggacgccctcatacacggaccgcgtcttgtacagaagccgccacaagggtgacatctgtcctgtgagctactcttcctgccccgggatcaagacgtccgaccaccgccctgtgtatggcctcttccgggtgaaagtgaggccggggcgagacaacattccgttggcagctggcaaatttgatagagaactgtacttactaggaattaaaagacggatttcgaaggagattcagaggcagcaagcactacagagtcagaactccagcaccatctgctccgtttcttgaagtttgctgaacgaggactcacagctgcaacgtggggtgattgtattgatcaaaacccactgggaaggacaaagagtttgccgcctttcggggatccgagggactgtggcgaccgtgcctctgtgccagcgtcccaggaaggaagccaaccctgagcgagcctgtcctctgtggcaggtccacacggtgtgggtgggcagggcttggacccccgtctccatggcaggtccatacagcatgggtggcagggtttggacccgcccagcagcaccacggaccccagccactctcgggggcagacgtcagaatccgttcctgagcagctcctgtgccctgggggcagtcacagagccccccaacacccccgtgctctgcaccagcctctccctccacacccgaagcaggcgtccatctgtgtcctcctggcagcccctcaaacacacaccaccccatgtcacacgggtatccagagcaaggctggatctgggctaggtgacccctggggcctcagacctctgagtgggccccagagcccagctgaggaagccacacagcctccaggacgtggcacggttcccctccacttggctgcaagtcgcctgccatggggcgaggaggcctgcaccccagtataagggcctccccagctgagtaagaagctgcttcccctcctctcataggccaagcctattgtgtgaaaccatctcatggtcttggtgacgtagaccatttttgaaaccgtctcatggtcttggtgacgtagaccgtttgcttctttaactccagccgcggaatgacattagtggaaccgggctagggaactgctggaagttcaggatgccaccaccttgaacacctaggccagggatccccaccatgtcccgggtttctttcttcgagagtatagaaccgttcattcttgctttgtgtcccattccatctcttgaaaaaatgtagtctttgaatgtgtgaaaatctagggacattcaatctagtcttttaaattatttttccatatttatatttttaaataaatgcatatattgagtcttaaaa

SEQ ID NO: 333204 - DNA, 1508 bp, Homo sapiens
agggcctggggtgcggcggctggcacaagctggtctgagccagtccgagtgcccatcctgtggcagggtccatcttcaagggcttccaggagccggacatccacttcctcccatcatacaagtttgacatcgggaaggacacgtacgacagcacctccaagcagaggacgccctcatacacggaccgcgtcttgtacagaagccgccacaagggtgacatctgtcctgtgagctactcttcctgccccgggatcaagacgtccgaccaccgccctgtgtatggcctcttccgggtgaaagtgaggccggggcgagacaacattccgttggcagctggcaaatttgatagagaactgtacttactaggaattaaaagacggatttcgaaggagattcagaggcagcaagcactacagagtcagaactccagcaccatctgctccgtttcttgaagtttgctgaacgaggactcacagctgcaacgtggggtgattgtattgatcaaaacccactgggaaggacaaagagtttgccgcctttcggggatccgagggactgtggcgaccgtgcctctgtgccagcgtcccaggaaggaagccaaccctgagcgagcctgtcctctgtggcaggtccacacggtgtgggtgggcagggcttggacccccgtctccatggcaggtccatacagcatgggtggcagggtttggacccgcccagcagcaccacggaccccagccactctcgggggcagacgtcagaatccgttcctgagcagctcctgtgccctgggggcagtcacagagccccccaacacccccgtgctctgcaccagcctctccctccacacccgaagcaggcgtccatctgtgtcctcctggcagcccctcaaacacacaccaccccatgtcacacgggtatccagagcaaggctggatctgggctaggtgacccctggggcctcagacctctgagtgggccccagagcccagctgaggaagccacacagcctccaggacgtggcacggttcccctccacttggctgcaagtcgcctgccatggggcgaggaggcctgcaccccagtataagggcctccccagctgagtaagaagctgcttcccctcctctcataggccaagcctattgtgtgaaaccatctcatggtcttggtgacgtagaccatttttgaaaccgtctcatggtcttggtgacgtagaccgtttgcttctttaactccagccgcggaatgacattagtggaaccgggctagggaactgctggaagttcaggatgccaccaccttgaacacctaggccagggatccccaccatgtcccgggtttctttcttcgagagtatagaaccgttcattcttgctttgtgtcccattccatctcttgaaaaaatgtagtctttgaatgtgtgaaaatctagggacattcaatctagtcttttaaattatttttccatatttatatttttaaataaatgcatatattgagtcttaaaa

SEQ ID NO: 333205 - DNA, 401 bp, Homo sapiens
  misc_feature (287)..(287): n is a, c, g, or t
  misc_feature (293)..(293): n is a, c, g, or t
  misc_feature (295)..(295): n is a, c, g, or t
  misc_feature (301)..(301): n is a, c, g, or t
agcgaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactctgcgntgtttntnaaagtnctgaattcatgttcttcccactaccctaagcttcccacctagtggaatatattcatcttgtttctttcagatgttgcaacaagacattaggcttctttac

SEQ ID NO: 333206 - DNA, 437 bp, Homo sapiens
cgagatacacaaggatcgagccaaaagctgcaacctccctctccacccccagtccccatattctggttttggcccaaggaaaatgtccattctatgaccttctcttttcctctcctctcacttctgcagctattctcacacaattgttcccctgcctgcgcccaggcttcctgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaatccaccagccctagaacctcccttgcctcaacagtcacctaataaagcccacctccatggaaaac

SEQ ID NO: 333207 - DNA, 1914 bp, Homo sapiens
agcgaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactggacagtgttctcaagaagtggcaaggagagactcaagagttctgccccaatgccaaggttgtgctggttggctgtaaactggacatgcggactgacctggccacactgagggagctgtccaagcagaggcttatccctgttacacatgagcagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatgtgaggggctaggagagggcagagtgtgaagaggggtggtgagggacacaattgttcccctgcctgcgcccaggcttcctgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctcttttcctctcctctcacttctgcagctattctcacacatctaacctctaggcaacatgcactaaattcaaaagcaaggagaagcccttgccccccatcagtccaccagccctagaacctcccttgcctcaacagtcacctaataaagcccacctccatggaaaacggctgtggctttagttttgttgctttttaaaaaaatcaatctaccaatctttagcagtaagagggaaagttagacctcagctggggaactttcctgtccatgtccacagatagagcagaggacaaagccataggttggatcagaagtgtccttttaggagtcagagttgggagaaggagacatcctgggactgttcatcctagttaatgaagtgggcaattctcaggccattagggggttttagagcagaccgacatataattagtcagcatttctcagcccagccaggcctgctgctagtgtgggaggggtcctgctcaccatctgtacccctggcttggagcctgctggtaccctgggggttgtggggataaggaggcatcaggccgggcgcgctggctcacgcctgtaatcccagcactttgggaggccgaggtgggcggatcacaagttcaggagatcgagaccatcctggctaacacggtgaaaccccatctctactaaaaatacaaaaaattagccaggcgcggtggcagtgcctgtagtcccagctgctcgggaggctgaggcaggagaatggtgtgaacccgggtgaacctgggaggcggagcttgcagtgagccgagattgcgccactgcattctagcctggatgacagagcaagactctgtctccaaaaaa

SEQ ID NO: 333208 - DNA, 1643 bp, Homo sapiens
agcgaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactggacagtgttctcaagaagtggcaaggagagactcaagagttctgccccaatgccaaggttgtgctggttggctgtaaactggacatgcggactgacctggccacactgagggagctgtccaagcagaggcttatccctgttacacatgagcagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatgtgaggggctaggagagggcagagtgtgaagaggggtggtgagggacacaattgttcccctgcctgcgcccaggcttcctgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctcttttcctctcctctcacttctgcagctattctcacacatctaacctctaggcaacatgcactaaattcaaaagcaaggagaagcccttgccccccatcagtccaccagccctagaacctcccttgcctcaacagtcacctaataaagcccacctccatggaaaacggctgtggctttagttttgttgctttttaaaaaaatcaatctaccaatctttagcagtaagagggaaagttagacctcagctggggaactttcctgtccatgtccacagatagagcagaggacaaagccataggttggatcagaagtgtccttttaggagtcagagttgggagaaggagacatcctgggactgttcatcctagttaatgaagtgggcaattctcaggccattagggggttttagagcagaccgacatataattagtcagcatttctcagcccagccaggcctgctgctagtgtgggaggggtcctgctcaccatctgtacccctggcttggagcctgctggtaccctgggggtgggaggagaggaagtgtatcctctagagtcagccatgagcatggcta

SEQ ID NO: 333209 - DNA, 820 bp, Homo sapiens
agcgaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactggacagtgttctcaagaagtggcaaggagagactcaagagttctgccccaatgccaaggttgtgctggttggctgtaaactggacatgcggactgacctggccacactgagggagctgtccaagcagaggcttatccctgttacacatgagcagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatctattctcacacatctaacctctaggcaacatgcactaaattcaaaagcaaggagaagcccttgccccccatcagtccaccagccctagaacctcccttgcctcaacagtcacctaataaagcccacctccatggaaaac

SEQ ID NO: 333210 - DNA, 522 bp, Homo sapiens
tgaaagctgatatgggattgacagcagaggaagtccggtgagggatactggagagtgagattctggatcgtaggaagcgaggagccggcggaggttgctgaggttcccgggatctgaggactggagcctcagcaacctctgccggctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctcttttcctctcctctcacttctgcagctattctcacacatctaacctctaggcaacatgcactaaattcaaaagcaaggagaagcccttgccccccatcagtccaccagccctagaacctcccttgcctcaacagtcacctaataaagcccacctccatggaaaac

SEQ ID NO: 333211 - DNA, 1233 bp, Homo sapiens
agcgaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactggacagtgttctcaagaagtggcaaggagagactcaagagttctgccccaatgccaaggttgtgctggttggctgtaaactggacatgcggactgacctggccacactgagggagctgtccaagcagaggcttatccctgttacacatgagcagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggatcgagccaaaagctgcaacctcatgtgaggggctaggagagggcagagtgtgaagaggggtggtgagggacacaattgttcccctgcctgcgcccaggcttcctgacctcctgatcctggctgggaagttagggcaggcagagcgagcaattctgggcaggggagctggagggcagaagggtatcatcgtttctcatctcctcctccctcctcttctccagtggatgttgagggagctaacagggctggcatctggggcatgaactgggatggggcaggtgggcgttagggaagctggtatcaaatggtgaccttggtggagtctcctatgtgaagagtaccctccctctccacccccagtccccatatcctggttctggcccaaggaaaatgtccattctatgaccttctcttttcctctcctctcacttctgcagctattctcacacatctaacctctaggcaacatgcactaaattcaaaagcaaggagaagcccttgccccccatcagtccaccagccctagaacctcccttgcctcaacagtcacctaataaagcccacctccatggaaaac

SEQ ID NO: 333212 - DNA, 845 bp, Homo sapiens
agcgaggggcagagcggccgctgcaagatcgtggtggtgggagacgcagagtgcggcaagacggcgctgctgcaggtgttcgccaaggacgcctatcccgggagttatgtccccaccgtgtttgagaactacactgcgagctttgagatcgacaagcgccgcattgagctcaacatgtgggacacttcaggttcctcttactatgataatgtccggcctctggcctatcctgattctgatgctgtgctcatctgcttcgacattagccgaccagaaacactggacagtgttctcaagaagtggcaaggagagactcaagagttctgccccaatgccaaggttgtgctggttggctgtaaactggacatgcggactgacctggccacactgagggagctgtccaagcagaggcttatccctgttacacatgagcagggcactgtgctggccaagcaggtgggggctgtgtcctatgttgagtgctcctcccggtcctctgagcgcagcgtcagggatgtcttccatgtggctacagtggcctcccttggccgtggccataggcagctgcgccgaactgactcacgccggggaatgcagcgatccgctcagctgtcaggacggccagaccgggggaatgagggcgagatacacaaggaaaatgtccattctatgaccttctcttttcctctcctctcacttctgcagctattctcacacatctaacctctaggcaacatgcactaaattcaaaagcaaggagaagcccttgccccccatcagtccaccagccctagaacctcccttgcctcaacagtcacctaataaagcccacctccatggaaaac

SEQ ID NO: 333213 - DNA, 182 bp, Homo sapiens
cgcatttccagcaccaagaacactgcctggatcatctgattaatgcctcacagtgttctcagcagcagcaggttctgacacctgtatttcataagagatgcctgcacccacggacgaaccagctgcaggctgtaccctcagctccaccagctcatctgaacacatcgctacagacacaaagg

SEQ ID NO: 333214 - DNA, 251 bp, Homo sapiens
gggccagatcttgatgcccaacattggttatgggagcaacaaaaaaacaaagcacattgctgctgatgtgcaacaaatcttactgtgccgagatcgctcacaatgtttcctccaagaaccgcaaagccatcgtggaaacagctgcccaactggccatcagagtcaccaaccccaatgccaggctgcgcagcgaagaaaatgagtagacagctcgtgtgcacgttttctgtttaaataaatgtaaaaactgc

SEQ ID NO: 333215 - DNA, 94 bp, Homo sapiens
tgtgggcaggttgcctgggagacctgcttccttccttgtttcctctgccagaggccaaaggaagagattcaggtcagaacccaagcttccccgg

SEQ ID NO: 333216 - DNA, 106 bp, Homo sapiens
cgtctcatgggatgcacattgtacgtgtccctctttccgagggaaagggacattatcttggtgttctttatatttgaaacacctacacaacggtgtcttgcatata

SEQ ID NO: 333217 - DNA, 1286 bp, Homo sapiens
ttttccttttttaaatagaaaaatgccaattaagctctttttcagtcttgggattgtttttgccttcagttggtagccctcaatagaaaataggtcttctgtcagcagatgttgacaacaaagaaagggaagcttttaatttgttcactaatagtgaaaaagcaaacatttacataacacaaatgtactgataaacacaattaaggatatatgcttgcctatttgtgatccaagtgttcaattaaaattatataattattgtgaaacagaggaggatgatgttcaagctatcaccgattggcctgctcttcatgtttgttaacattccggggacaaacttcaacatcaacaacctcaaattctatggcagtatccaatcctgcgtcaagcctgaatcccgggaccagacctaatcccaggaagagcaccaatcccagaatgaaccccaatcctgggataagcccagatctcaaaatgacctcgagtcccaagatgactccaaattccaagacaagtctgaatagagcagtgaccccaaagagccacaactatgaatatgaatactgtgacaaatggtagcaccaatcctgggacaagcccaaatctcaaaatgacctcaaatccctagatgactccaaattccaagacaagtctgaatacagcagtgaccccaaagatagccacaactatgaatatgaacactgtgacaaatggtagcaccatactcaatccaatggacaacatttattttctatgtaatatttttgctgttttgtgtatacttgcactcaggctgaagtgaacttcaactgcctgcattcttatctcagtttcttattattgctgaatgacaagcatgctaggaaaatatcatttatttcaatttactatttaagaaattatcatcttgatttttttttgcaaattataattgtgtacgtttaaatattaacttaatatgatgttttccttccatatgaaagaagtatgcactaccttattaaatgctgaaacaagcaaaataccatgtttgccttttaaatgtttgcaaaactgaaccaaaactcagatatttatattaaaggtgtaagagaagaaattatgtaggtggggtgtgtgtgtgtgtgtggtgtatgtgagagagagcacacacatgagagtgagagagcgagtgagcaacagtgacagagagatgaaggataggggataggggatagaggatgggggtgtgggataaggagtggtatgggggaagttgtttttgtattttatttttatttttttga

SEQ ID NO: 333218 - DNA, 597 bp, Homo sapiens
ttgtaggcgtgtctgggactgtactgttctagaggcccaggtctttcagtttacccaagaacaagagctgcctcagggtttctcctctttccaggagggagtcttaggggcatggcacagccttagtgacattgatgtgtggaagaggttctgggtatttttgagatccgctagctttttagtgtttaacccttcagtttgaccaacatatttgacacacctaagcaccaggccctgtttggccctttaacacgttacttcccttcatcttgtccacctgatttacctcccttagcccctgccaccttgactcctagtgccctgctccaccgcacaggagctgccgggggaggtcgaggctgggaggcaggtgttgtgtgtctgggaccctctgattcttttcctcccgggcttgctaccatgagtctgatggagaccagctctgacctggggagctgggtcttcacctgtgcgcctgcattctgtcactggtgaatttcacctgagtatcatttgagtttgcgttccccacctgtaaagcagaagcagctctccctggttcatctgggagatgaacacttgtaccagcataaggtg

SEQ ID NO: 333219 - DNA, 361 bp, Homo sapiens
tggggctgggtgtggggacaggtctcttagaaggatagggagcagggccgccaggtgtgtgctttgaggtgcctggcagcttagagctaatggcagctgtgttttgctacagcgttaccttccccaaggctggtaatgggatgaaccaaaagaaactactgacttatttttctaggggactggggcttgggcagaaggctgcattttcctcctgggtaggacctggatcaggatagcccatgatgaatttgaccctgatgactctatagtggggaacaatgtcctcaggaaagcattcaggaaacccttcgtgtagtagtgatcaaagctctggagcagctcagcaggatggatgggaaaa

SEQ ID NO: 333220 - DNA, 408 bp, Homo sapiens
ttttttttaatggatgtcagattatgtcattcctctattcaaaactctccaatgtcttcctatttaactcagaataaagctctccatgatctggtccctgtctacccttgtgacttctccatattcctatctcccccttcgtttactccatctgtagccacactggcctcctttcgttccttagaatcaagaagcacgctctatgcctagaaagttattcccccaaagatacacatagctcactactccagttcttgcatatttctgcacaaattttattttctgagaggccttctttaataatccagtgtctccctattcccttaccctgctatttttcttcagatttattcatttatctgctttcctctactagaacgtaaactacagagagaaaactattttatt

SEQ ID NO: 333221 - DNA, 118 bp, Homo sapiens
cagcctggacatcatagtgagacaccctctctgaacaaacaaacacacacacacaaacactgcagctgtgggagccaggaagtctttctggtgtcacagctcatgctcagcccttcgg

SEQ ID NO: 333222 - DNA, 288 bp, Homo sapiens
cttctgtcccctctccttctccctgtcccagggcctccttctttcatctctcctcctcgtcccctccttttctctctgctgttcctctagcatgccacactcatgcccagcacagggcctttgcacttgctgtttcttctgtctgcagctcaggtctcctggatgcttgatgactgactcttgatcattccttgggtctttgcacaaatgtcacctcctctgggatggtatgcctgactgctccagttgaaactcctcctcatgcagccactctgttacatttcactt

SEQ ID NO: 333223 - DNA, 3629 bp, Homo sapiens
ccggctcgacggctcggtcaccgcctcgctgtcgtcgcggcgcccccggccgtcctctgtccgtaccgcccccggagccagggccgagtcctcgccatgccggcccggcggctgctgctgctgctgacgctgctgctgcccggcctcgggatttttggaagtaccagcacagtgacgcttcctgaaaccttgttgtttgtgtcaacgctggatggaagtttgcatgctgtcagcaagaggacaggctcaatcaaatggactttaaaagaagatccagtcctgcaggtcccaacacatgtggaagagcctgcctttctcccagatcctaatgatggcagcctgtatacgcttggaagcaagaataatgaaggcctgacgaaacttccttttaccatcccagaattggtgcaggcatccccatgccgaagttcagatggaatcctctacatgggtaaaaagcaggacatctggtatgttattgacctcctgaccggagagaagcagcagactttgtcatcggcctttgcagatagtctctgcccatcaacctctcttctgtatcttgggcgaacagaatacaccatcaccatgtacgacaccaaaacccgagagctccggtggaatgccacctactttgactatgcggcctcactgcctgaggacgacgtggactacaagatgtcccactttgtgtccaatggtgatgggctggtggtgactgtggacagtgaatctggggacgtcctgtggatccaaaactacgcctcccctgtggtggccttttatgtctggcagcgggagggtctgaggaaggtgatgcacatcaatgtcgctgtggagaccctgcgctatctgaccttcatgtctggggaggtggggcgcatcacaaagtggaagtacccgttccccaaggagacagaggccaagagcaagctgacgcccactctgtatgttgggaaatactctaccagcctctatgcctctccctcaatggtacacgagggggttgctgtcgtgccccgcggcagcacacttcctttgctggaagggccccagactgatggcgtcaccatcggggacaagggggagtgtgtgatcacgcccagcacggacgtcaagtttgatcccggactcaaaagcaagaacaagctcaactacttgaggaattactggcttctgataggacaccatgaaaccccactgtctgcgtctaccaagatgctggagagatttcccaacaatctacccaaacatcgggaaaatgtgattcctgctgattcagagaaaaagagctttgaggaagttatcaacctggttgaccagacttcagaaaacgcacctaccaccgtgtctcgggatgtggaggagaagcccgcccatgcccctgcccggcccgaggcccccgtggactccatgcttaaggacatggctaccatcatcctgagcaccttcctgctgattggctgggtggccttcatcatcacctatcccctgagcatgcatcagcagcagcagctccagcaccagcagttccagaaggaactggagaagatccagctcctgcagcagcagcagcagcagctgcccttccacccacctggagacacggctcaggacggcgagctcctggacacgtctggcccgtactcagagagctcgggcaccagcagccccagcacgtcccccagggcctccaaccactcgctctgctccggcagctctgcctccaaggctggcagcagcccctccctggaacaagacgatggagatgaggaaaccagcgtggtgatagttgggaaaatttccttctgtcccaaggatgtcctgggccatggagctgagggcacaattgtgtaccggggcatgtttgacaaccgcgacgtggccgtgaagaggatcctccccgagtgttttagcttcgcagaccgtgaggtccagctgttgcgagaatcggatgagcacccgaacgtgatccgctacttctgcacggagaaggaccggcaattccagtacattgccatcgagctgtgtgcagccaccctgcaagagtatgtggagcagaaggactttgcgcatctcggcctggagcccatcaccttgctgcagcagaccacctcgggcctggcccacctccactccctcaacatcgttcacagagacctaaagccacacaacatcctcatatccatgcccaatgcacacggcaagatcaaggccatgatctccgactttggcctctgcaagaagctggcagtgggcagacacagtttcagccgccgatctggggtgcctggcacagaaggctggatcgctccagagatgctgagcgaagactgtaaggagaaccctacctacacggtggacatcttttctgcaggctgcgtcttttactacgtaatctctgagggcagccacccttttggcaagtccctgcagcggcaggccaacatcctcctgggtgcctgcagccttgactgcttgcacccagagaagcacgaagacgtcattgcacgtgaattgatagagaagatgattgcgatggatcctcagaaacgcccctcagcgaacgacgtgctcaaacacccgttcttctggagcctagagaagcagctccagttcttccaggacgtgagcgacagaatagaaaaggaatccctggatggcccgatcgtgaagcagttagagagaggcgggagagccgtggtgaagatggactggcgggagaacatcactgaccccctccagacagacctgcgtaaattcaggacctataaaggtggttctgtcagagatctcctccgagccatgagaaataagaagcaccactaccgggagctgcctgcagaggtgcgggagacgctggggaccctccccgacgacttcgtgtgctacttcacgtctcgcttcccccacctcctcgcacacacctaccgggccatggagctgtgcagccacgagagactcttccagccctactacttccacgagcccccagagccccagcccccagtgactccagacgccctctgagcgagggcggcccctctgttctggtggccccagctgtgactgagggcctggtcaccacaattagagcttgatgcctcccggctttgcagggagaccaggcttcccaaaccaagtgccttgagctgcctgctctgcagcccacagaggacagtgctgaccccaggaagtgggagaagtggcccctcgtgacctacagggaactgggaagatgctggccccaaaagccttacggtcatgatgtctgcaaaggagggcctcagagacagcgcgagtagcacccccagccatctactggataaacttgcttcagactttttaaattcctgcttaatgtcagtctacaggcctttcaggaagggagaggagggaatcgtacattttgcttgcgtgctgggacagctaggctgagatgcaccaagtacagccttcactggagaccggaattgagaggtgggggatgctgaggagggggaggacggagttcagagggtgtcgtcctgcagtatgagatttctcattgatcacagatgtgcccagagtagcccaggtcactgttaactagtgtttctgcagaggcagcaggagccagcccggaattc

SEQ ID NO: 333224 - DNA, 1376 bp, Homo sapiens
ccggctcgacggctcggtcaccgcctcgctgtcgtcgcggcgcccccggccgtcctctgtccgtaccgcccccggagccagggccgagtcctcgccatgccggcccggcggctgctgctgctgctgacgctgctgctgcccggcctcggggtgagtgaccggggagcgtggggtggaggacagctcgcgacggccgggtcggggccggggcagcgtcgcggcgccggggctggagtccgagctgggagcgcgacggcggcggccagatgccccgtgagcccagccgtgggaggctcgggccgggcgtaggaggcggcaccgggccgggagagcttccctgacgggagtcgcggccccaccgaggcgtcggccgcccgaagagcctcccaagccagcgcggctgtcacgggcagcggctccccggaccccgcgggctcgggcgcaacttcgtggcgtcctgcacggcacttgggggtcccagaaggccccggcctgaggaggccgcccacctgcgggaccctcctcctcgcgggcgggcgccggcgctgcctggcgggggccgcggaggagccgaaagggcgttgggatccaggggaagggtctgtcctgcgcttcgaatccttgtttgaactttttaaaaattcgaaaactttggggaacgaatgcaacagggagtaaggactctcacccgagagctggcttctgccacttgccctgccggtttcttggtactgggaggctgcaggcttccttctgtgcaccgagacttccttgagcaagtggagctgtgggaattgcactcttggaagatcccgcatgggttcgaggtgaggccgcttcagaacctcaaatgaaagactgtctcctcgtgggagagcacctggggccatcagaaatgtcttttcatctttttctggaggagacgaatgatagggcctggtttacattcatttaactctttatgaccttcactcagctgtggatttgggggcactttgtgggagacttggcttttttttttcttctggttggaagaacctaaattagcgaatgtttttcacaaaatgtattgttcaggatgtgagcgtggcaaatttgtccgtgttctgtttaatgacctctttaaaggtactgtgtactctttaatagggatatcatgtaccaggtgtcccagtagagcactgacatgtgtgtgcctgagtgccagccaccgtgtgaactctttggaggttttgcattttaggtaaataactgtctgtactcttggagtaacaagaatttggaaacaggagaagtaaataaataaggttgcctttttcaaattcagggtttttttttttaaataaaggaaaatttgtagactctttataatagaa

SEQ ID NO: 333225 - DNA, 1320 bp, Homo sapiens
ccggctcgacggctcggtcaccgcctcgctgtcgtcgcggcgcccccggccgtcctctgtccgtaccgcccccggagccagggccgagtcctcgccatgccggcccggcggctgctgctgctgctgacgctgctgctgcccggcctcggggtgagtgaccggggagcgtggggtggaggacagctcgcgacggccgggtcggggccggggcagcgtcgcggcgccggggctggagtccgagctgggagcgcgacggcggcggccagatgccccgtgagcccagccgtgggaggctcgggccgggcgtaggaggcggcaccgggccgggagagcttccctgacgggagtcgcggccccaccgaggcgtcggccgcccgaagagcctcccaagccagcgcggctgtcacgggcagcggctccccggaccccgcgggctcgggcgcaacttcgtggcgtcctgcacggcacttgggggtcccagaaggccccggcctgaggaggccgcccacctgcgggaccctcctcctcgcgggcgggcgccggcgctgcctggcgggggccgcggaggagccgaaagggcgttgggatccaggggaagggtctgtcctgcgcttcgaatccttgtttgaactttttaaaaattcgaaaactttggggaacgaatgcaacagggagtaaggactctcacccgagagctggcttctgccacttgccctgccggtttcttggtactgggaggctgcaggcttccttctgtgcaccgagacttccttgagcaagtggagctgtgggaattgcactcttggaagatcccgcatgggttcgaggtgaggccgcttcagaacctcaaatgaaagactgtctcctcgtgggagagcacctggggccatcagaaatgtcttttcatctttttctggaggagacgaatgatagggcctggtttacattcatttaactctttatgaccttcactcagctgtggatttgggggcactttgtgggagacttggcttttttttttcttctggttggaagaacctaaattagcgaatgtttttcacaaaatgtattgttcaggatgtgagcgtggcaaatttgtccgtgttctgtttaatgacctctttaaaggtactgtgtactctttaatagggatatcatgtaccaggtgtcccagtagagcactgacatgtgtgtgcctgagtgccagccaccgtgtgaactctttggaggttttgcattttaggcattttcccgtatgctttctttcatgttacaagtatttgataacgtgaaaagcaaaataattaggatgcctatgtc

SEQ ID NO: 333226 - DNA, 234 bp, Homo sapiens
atagtgtataccaccataggggtattttatttatctgtggttgaagtgagagagagtagtgggtggaattgtcttatatactcacttatacacctacacacaaccaccctccactctctattcctccatcatgggtttgcgtggctttggtatgttgttccatgccctgggctgtaatttatctttgatatttattatttaatctctaggcctgcctttctcccagatcctaat

SEQ ID NO: 333227 - DNA, 509 bp, Homo sapiens
gcaggcatcatgggcatcgtctagtccagccctgcgattttgctgaggcttgccattaggtggcttgtccatgtttctgcagtgagtgacagctgggatgaagtcctgtggtcctgttcccagggcagtgcccctagcttcacacccctactgcgttcctccatgtctggggggttaatgtggtcatccctgcgggtggtatttggggtgatgattactcccttctgtgggatctggaaattcaatgactctggaatgcatgtatctgtttttctcctaggcccactctgtatgttgggaaatactctaccagcctctatgcctctccctcaatggtacacgagggggttgctgtcgtggtaagtccactacggagggctcgcagctgcctaaccacttctgttccattttagcaaagaatgactttgctatgcatgagcatcctgcaggttaagaatgaaaaacacaaatcttaagttctcaaaaacagtttctgcacatgccacatt

SEQ ID NO: 333228 - DNA, 668 bp, Homo sapiens
cttggttaacttttttttttctttttttttttttttaaagaaacttccttttaccatcccagaattggtgcaggcatccccatgccgaagttcagatggaatcctctacatgggtaaaaagcaggacatctggtatgttattgacctcctgaccggagagaagcagcagactttgtcatcggcctttgcagatagtctctgcccatcaacctctcttctgtatcttgggcgaacagaatacaccatcaccatgtacgacaccaaaacccgagagctccggtggaatgccacctactttgactatgcggcctcactgcctgaggacgacgtggactacagtaagtgctctctgctggatttcacaagcttgggccagtacttttgacctatgtggaaacagtggctccagaaagtaggattttcttttaagatactctttgtcaccaggttctttctttccatggacttttcatgggcttatcataaatacttcccacagtcaatgtgcaggggccttggtgaagtctgaagggaaaccgaagtaaaatggtgacaagcttagccagagaggaaggaggacatccctcgttgagtctttctatgtcacagaaggaatttactgcaagcccatggaaagtagaagtaaaatcagcataggacattaacaa

SEQ ID NO: 333229 - DNA, 1573 bp, Homo sapiens
ccggctcgacggctcggtcaccgcctcgctgtcgtcgcggcgcccccggccgtcctctgtccgtaccgcccccggagccagggccgagtcctcgccatgccggcccggcggctgctgctgctgctgacgctgctgctgcccggcctcgggatttttggaagtaccagcacagtgacgcttcctgaaaccttgttgtttgtgtcaacgctggatggaagtttgcatgctgtcagcaagaggacaggctcaatcaaatggactttaaaagaagatccagtcctgcaggtcccaacacatgtggaagagcctgcctttctcccagatcctaatgatggcagcctgtatacgcttggaagcaagaataatgaaggcctgacgaaacttccttttaccatcccagaattggtgcaggcatccccatgccgaagttcagatggaatcctctacatgggtaaaaagcaggacatctggtatgttattgacctcctgaccggagagaagcagcagactttgtcatcggcctttgcagatagtctctgcccatcaacctctcttctgtatcttgggcgaacagaatacaccatcaccatgtacgacaccaaaacccgagagctccggtggaatgccacctactttgactatgcggcctcactgcctgaggacgacgtggactacaagatgtcccactttgtgtccaatggtgatgggctggtggtgactgtggacagtgaatctggggacgtcctgtggatccaaaactacgcctcccctgtggtggccttttatgtctggcagcgggagggtctgaggaaggtgatgcacatcaatgtcgctgtggagaccctgcgctatctgaccttcatgtctggggaggtggggcgcatcacaaagtggaagtacccgttccccaaggagacagaggccaagagcaagctgacgcccactctgtatgttgggaaatactctaccagcctctatgcctctccctcaatggtacacgagggggttgctgtcgtgccccgcggcagcacacttcctttgctggaagggccccagactgatggcgtcaccatcggggacaagggggagtgtgtgatcacgcccagcacggacgtcaagtttgatcccggactcaaaagcaagaacaagctcaactacttgaggaattactggcttctgataggacaccatgaaaccccactgtctgcgtctaccaagatgctggagagatttcccaacaatctacccaaacatcgggaaaatgtgattcctgctgattcagagaaaaagagctttgaggaaactttgttacagatgacttcagtgttttcctggatactgaacctaccatcaaaggaggaagtgtttgcctttttgaggatttttgaaaaaaatatgtagggtctgaagacacctgccaaaagtattgctccaaaaactatttttgaataatgataacctcactgcaaagatgcatggcctctcaaagcaattgctttgaaagaggcaacagttatctggctacatgatctttggtgagcttaaaacaaataaaaccccctgcagtacagtc

SEQ ID NO: 333230 - DNA, 666 bp, Homo sapiens
tcacatgatactaaaagcacaggtaacaaaagaaaaaaatgataattggacttcattaaaatgtaaaacttttgtgactcaaaggacactattgtctgggtacagtggctcatgcctataatcctagcactttgggaggcccaggcgggcagatcacaaggtcaggagttcgagaccagcctgcccaacatggtgaaaccccatctctactaaaaaaaaatacaaaaattagctgggcatggtggtgtgtgcctgtaatcccagctactcgggaggctgaggaagaagaattgcttgaacctgggaggtggaggttgcagtggtgagccaagattgtgtgactgcactccagcctgggcgacagagcaagactccgtctcaaaaaaaaaaaaaaaaaaaaggacactatcaagagagtgaaagacactctacacatctaaaggtctagtagccaggatgcattaaaaaaactctgataacaacaaaatcaccaacaatccaatttaaaaataggcactagatttgaatagacatttctccaaagaagatatacaaagagccattaaacacattaaaagatgcttaatatcactggtcagcagtcaacagagaaatgtaaataataacaacagtgagataccacttcacactcacaaggatagctgt

SEQ ID NO: 333231 - DNA, 537 bp, Homo sapiens
ccctttggggcattctccggcaactgagaatcacgtgagggtgtctgggaggaatgctccctaagatgtgcagcagctctaagtaggtttccccctcagaagaacatatttagggtctaatctcagcaaacaggcacatataaggagctgacccttcctgcaccttgagcccctgacatgctgtgccaggtagctctgacacaggtggactgaaccggttctgggggtaatgaccctgaaaaactaggtctgcaagcagcacactttgtgtccaacacatgtcctgacttggccaaatctgaaggggaaatctaaattattgggaatgagtcctctaagttagctaaaaccccagcagctgtggaccatagttccacctttagaaactctggccaggtatatgcaaaatacttgtggtgaattgtcatgtaaatatttaaccaagtggaccactgtaactaaagcagattctaagttacagtggcctaaatggggatcttttgagatgcacaaattcgtgtacctgtgaaccaggat

SEQ ID NO: 333232 - DNA, 621 bp, Homo sapiens
cttaaagtattttcagaaatctgaggggaacatcacctgtgctttattggttattttgacaagtgaaatagaggacaaactgctttgatttgagttgatgtctacacatgtgaactcatgagaaacagcaaagcccacaatccacatggacatcatcatcgttcgggaacaggcatggtctccattctttccatgcacacgccccggcttcaaaaagacatctgaaacactagtgatgaccatcattaccccatctgtgagctccaggcacggcacagccctgcaaggtaaatgttattactgaaggtcagagaagttccgtagcttgcccagtcacatacctggcacggagctaagccaagcttcgagctcaagtcctcctgatgcgaaagttatttccactgaaccagcccaggcaaaatcctggtcgggtctgtgttactcttggctttcaaaacagatagccttgaggagatgtgtgtgtgtgttcatttaaaaaaatccagaaacgaccaaactctggcaactttctagaacgtattttgtacctaaatgaatgtggctcagtattgcctttgtttagactttgaataaaattgaacaaatcattagaagccctat

SEQ ID NO: 333233 - DNA, 334 bp, Homo sapiens
gtaacacaggcagaggtgtgggggcagggcacagattttggtctcctgaagtcccttgaactgaaattgttgggtaggtctcgagaaaaggccctctgttttctctccaaaccagtcaaggctggttctgcatcacagagcctccagctctcatccctccccttctactacagcccagagaccaaaatttaacccagggaaaaagggtagtgatggtgagggttaaatccagggttgggcgtcaatcaggagctgaggatgttaaagcagtgtggcagaggggaccccaacccaacacccttggcctccctcccctcctgcccagggtcggggt

SEQ ID NO: 333234 - DNA, 431 bp, Homo sapiens
ctcgcgaacgtgttatccttaatgattctgtgtttagtaatgctttttcagaatcattaaggataacccttagaatatcattcccacaatactattactccattttcaatcactgagtaaggtacatatttttttaagaccaaatcacattcttgtacttaaaaatataatttccacccttattcgttgtatacaaatttctcttctgccaaatacctgaaacaatgatgaactaactgaaaaggatgggcttttcctcttagcatagccattctaacagtaactaattcactttcaaatacttgtatattaaaagtaaaaaaaaaaatgggggccaggcacggtggctcacgcctgtaatcccagcactttgggaggccgaggtgggtggatcacgaggtcaggagatcgagaccatcctggataacacg

SEQ ID NO: 333235 - DNA, 297 bp, Homo sapiens
aggtgaaggggtgaacaggcaaggagacaggtgaaggggtgaacaggcaaggagacaggtgaagggatggactggtgaagagatggccagatgagaagatgaacaagtgaggaggtggacagataaggagacaggtgaagggatggccaagtgagatgaacaggtgaggggtggacaggtgaagagacagtgaggggatgaacaggtgaggggtggacaggtgaagagacagtgaggggatggacaggtgaggggtggacagatgaggggacaaacagctgaagggatggacaggtg

SEQ ID NO: 333236 - DNA, 192 bp, Homo sapiens
tagacagtgttttgttctgttgtccaaactggtgtgcagtggcgcaatcaaagctctgcaacctcgaactcccaggcttaagcaatagccccacttcagcttccctagtagctgagattataggtgcacaccaccatgcctaactgtttgttttttttttgtttttttttttttgagatggagtttcgctct

SEQ ID NO: 333237 - DNA, 450 bp, Homo sapiens
gagaatgatggtgtgcaggcaacagtgatcagcaccaccatggtttgcagacaggcctcgatcaggcccactgtgggcatctacctctagttccatcagcttcctaaaatctgaaatacttttagagatccggaaaccagaatagggtttctccaagtgggagataatgtcagcctgatttaatgagaaattgcaaaaatacttgttcaaactgaggctataggaataccagccagaagaacaaacaaattcttcagggaagcatccagcactgaagtggcagcttctaaatgaactgaaattttctgcatgttctctcagaaagttacagtgttaattaattaataaaatcattacaaaagaatttcttccgaggtatgatggagcatgtgatgacttcaggaatggcttgatttgtttgtttgtttgtttgtttgttttttgagacag

SEQ ID NO: 333238 - DNA, 1232 bp, Homo sapiens
ctcacggcagaaagcccaattccatctggcccctgcaggttggctcagcactggggaatcagagtcccctccatgaccaaggcaccactccactgacagactctgttaatcagcttgcttggctggcctccaaccataggtccaggggctgagacaaggtccttttgagctcctatgtgggaggctctggaaagcttagcaacactttccaacaactttgccagggtcacatctcccaggaagatctcacttccccacagaagctcttggcctggcctcctgcagtgccacgctccgtgtatttgacaagctgagttggacactccatgtggtagagtgtcagtttgtcaaataccccaagtgcggcacatgcttaccagctctaggccagggcagatgggatatgacgaatggactgccagctggatacaaggatgctcaccaagcaccaagttctcacaagttattttatgtgactttgcaggaactgaggcattatatctgaggacaccaggggaaaagtgtggcatctcagggaaatacagccctgggctgtgtctacacacaccatgagagtgctgatgggggcgcaatagtcttgaaaatgtataaagtgtccaggaatggaagtgctctttgattcattattattttcttccttcatattcccctcccagagtctcctatctaggacatcagcattctcacacaagcctaatggcttatctgagtaagcagggcttagaaattcactttcttgatactcagtcttgccttctaaacactccttgatcttgcctacctctccccttttccacatgtcttttcctgtaggaacactttctccatttattcctgcctatccaattcttccctatatttcctggaccagctaaagtccagtgtttccagagacttttgaaagtcaacttacactttttccttcttcattcacaaagctcttcttccctgggccctggtatgtatgcctttctctcctactgtctaatagcacctcgtaaattgtcaatgaacttttctaaggggtattcttgaattcccaactagattgtgagcttctggaagacaaggctatgtctttgattgttgtctcccctaccacagcccagtactttagttacagaaaataataaatatttactgattgattgactttcctcttgtccactagctttaggtttgggggccaaattctaccctggattttgaaa

SEQ ID NO: 333239 - DNA, 1181 bp, Homo sapiens
ctcacggcagaaagcccaattccatctggcccctgcaggttggctcagcactggggaatcagagtcccctccatgaccaaggcaccactccactgacagactctgttaatcagcttgcttggctggcctccaaccataggtccaggggctgagacaaggtccttttgagctcctatgtgggaggctctggaaagcttagcaacactttccaacaactttgccagggtcacatctcccaggaagatctcacttccccacagaagctcttggcctggcctcctgcagtgccacgctccgtgtatttgacaagctgagttggacactccatgtggtagagtgtcagtttgtcaaataccccaagtgcggcacatgcttaccagctctaggccagggcagatgggatatgacgaatggactgccagctggatacaaggatgctcaccaagcaccaagttctcacaagttattttatgtgactttgcaggaactgaggcattatatctgaggacaccaggggcatgagagtgctgatgggggcgcaatagtcttgaaaatgtataaagtgtccaggaatggaagtgctctttgattcattattattttcttccttcatattcccctcccagagtctcctatctaggacatcagcattctcacacaagcctaatggcttatctgagtaagcagggcttagaaattcactttcttgatactcagtcttgccttctaaacactccttgatcttgcctacctctccccttttccacatgtcttttcctgtaggaacactttctccatttattcctgcctatccaattcttccctatatttcctggaccagctaaagtccagtgtttccagagacttttgaaagtcaacttacactttttccttcttcattcacaaagctcttcttccctgggccctggtatgtatgcctttctctcctactgtctaatagcacctcgtaaattgtcaatgaacttttctaaggggtattcttgaattcccaactagattgtgagcttctggaagacaaggctatgtctttgattgttgtctcccctaccacagcccagtactttagttacagaaaataataaatatttactgattgattgactttcctcttgtccactagctttaggtttgggggccaaattctaccctggattttgaaa

SEQ ID NO: 333240 - DNA, 925 bp, Homo sapiens
ctcacggcagaaagcccaattccatctggcccctgcaggttggctcagcactggggaatcagagtcccctccatgaccaaggcaccactccactgacagactctgttaatcagcttgcttggctggcctccaaccataggtccaggggctgagacaaggtccttttgagctcctatgtgggaggctctggaaagcttagcaacactttccaacaactttgccagggtcacatctcccaggaagatctcacttccccacagaagctcttggcctggcctcctgcagtgccacgctccgtgtatttgacaagctgagttggacactccatgtggtagagtgtcagtttgtcaaataccccaagtgcggcacatgcttaccagctctaggccagggcagatgggatatgacgaatggactgccagctggatacaaggatgctcaccaagcaccaagttctcacaagttattttatgtgactttgcaggaactgaggcattatatctgaggacaccaggggaaaagtgtggcatctcagggaaatacagccctgggctgtgtctacacacaccatgagagtgctgatgggggcgcaatagtcttgaaaatgtataaagtgtccaggaatggaagtgctctttgattcattattattttcttccttcatattcccctcccagagtctcctatctaggacatcagcattctcacacaagcctaatggcttatctgagtaagcagggcttagaaattcactttcttgatactcagtcttgccttctaaacactccttgatcttgcctacctctcccctaccacagcccagtactttagttacagaaaataataaatatttactgattgattgactttcctcttgtccactagctttaggtttgggggccaaattctaccctggattttgaaa

SEQ ID NO: 333241 - DNA, 500 bp, Homo sapiens
agagatggaaggtagctcacagagtcatgacatcttttggagaaggagctgttggaattagctgtattattagatgtacatggttggggggagatgaatcaaagcacgattcctagctttttagtttgaacaactgaaaggatggtagctccatttccggagatgagaggactgaggagatcatgatccggggggaatatttggtctttaacatgtgagcccattggacgagcatttgggtaacttcagtcttactcctcagcagctgctgttggcagggtgtggtcaggtaggctggcactgtgtctgagcaagccagctctggtctgataacagagttttatctggaaggggaaacccagggctgggcttacgatctaaggtcagcagcctgtcacaccaagaaataaatgtctgttaaggcaattggtacataagcactcagaaagtgtagcttgtcaaagtggcttaattccaactaggttgttattactcagttg

SEQ ID NO: 333242 - DNA, 294 bp, Homo sapiens
atctacagatgtgtgtctgtgcttgtccttccaccaccaccaccaccagcagaatcacatacagagttcttatcctctcttctgtttgcctgtctctgattatcttcacccctgtgagggtgtctgttgctttcttctcttgtttttgcccttcatctctcttttcaaacccctcaccctttgaaatcccttttgttcagaacgctttcttttcaatttctcttctcttccttcttttaccacctgtttgcctgctggggcacatcctggccctttctcccgtacaattcagcc

SEQ ID NO: 333243 - DNA, 846 bp, Homo sapiens
acaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgaggtatgtgaagctgatgttttgctgttaagtaacactttacacctggaaagtggaattcctttatgtggtcttgcctctccatcagactacgacagaggaaaaagcccatctatctttacagacccagggaaaggaaagtgggtagaattggaggggaaaataatcaggttatgtactggttgctttataggtagagatgtccattctggggttaattgactggggaaatagtgacctgtcagtcacatcaccttatatgtcagaatggaattttggtcctgagcagttgagagttttacttcactgtgagcctattagcttcatttatcttcagtgtctcaggggaagggttccccatccctacagtaacatttgttcatcatcctttcaacaaatttagctgacctgtgaaaaagcccttc

SEQ ID NO: 333244 - DNA, 440 bp, Homo sapiens
catagagaaaatgtattcacctctgcacagagtcagtgatagcatttatgctgtttctcaactcagaatttgcaaacaaaaaaagttataaaattggagtttgttacttactaattttagaattctcacttagtaatgaaagtattttagaagtatgtgtttatcgtttttcttatttctctctttcaattttccttttttctccccctccatttcaaatgggaagctggtatgaatatgagcccagtctctcgactaaaaaaaacttgggccaaagtgaagactgcaaaatttgacattcttgaggtatgtgaagctgatgttttgctgttaagtaacactttacacctggaaagtggaattcctttatgtggtcttgcctctccatcagactacgacagaggaaaaagcccatctatctttacagacccagggaaagg

SEQ ID NO: 333245 - DNA, 740 bp, Homo sapiens
acaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatg

SEQ ID NO: 333246 - DNA, 283 bp, Homo sapiens
tctccctatgtttcccaggctggtcttgaatttctggccttaagtgatcctcctgcctcagcttcccaaagtgctgggattacaggtgtgagccaccatagccatccccttaattgtgttttctatgtgtcaaccactagctatacactaggagaactaataaaaaatatgatactttttcctgcctctacaagccatgtaatctagctgaagaaataaaatggacataaatgaaatagttaaagaggtaattgtcaaactgtgaagttgttaccaagtagga

SEQ ID NO: 333247 - DNA, 543 bp, Homo sapiens
taattatttgaccttggtgaagttaccaaaactccctgagtctttttccctcatcaataaaatgaagataataagaatatgtctgatattgaactaggctcacaattattttctttcagaagacttttcctgggctgggggatagatagatttgatgggagaagcaagtaatttcctgttttaagtaaagaactctatatacaatgagggcatatccaacatcacacagtcatgtgaaaggctatttttcttttgtcagagaagataaggagaataacaataaagcttataagaattcagttgcactgcagtgcagcagatcctaaatctgttcatgttccaaaaatagaattcacgtcatcaaatgcaacagctccaagtaagtggctgatcatctctggaaacaacagctcctcagggtcgttcatagataccctatgatactccttcccagaaagtcaaacataggagcctagagccatgaatggaactatttatagtcatgcctttaaatgaaatagcattttaaggaagtatataaat

SEQ ID NO: 333248 - DNA, 736 bp, Homo sapiens
ggtctgtacattgactatagcagagaaaccccctccagccatgcctcacagtagggttcagaaggctcttttctgtccccgtttctgtttgctcctgtatggaaagcagctgagactctgggcattacaatcatttggcaatggccgggcacggtggcttatgcctgtaatcccagcactttgggaggccgaggcgggggatcacttgaggtcaggagttcaagaccagcctggccaacatggcaaaacctcgtctctagttaaaatacaaaaattagctgagcatgggggtgggcacttgtagtcccagctactcgggaggctgaggccggagaatcccttgaaacccagaaggcggacgttgcagtgagctgagctgatgccactgcactccagcctgggtaccagagcgagactctatctcaaaaaaaaaaagaaaaaaaaaaagaaatcggccgggcacggtggctcacgcctgtaatcccaacactttgggaggctgaggcgggcggatcaccaggtcgggagtttgagaccagcctgaccaacattgtgaaaccccatctccactaaaagtacaaaaaattagccgggcatggtggcacatgcttgtagtcccagctacttgggagggtgaggcaggagaattgcttgaacctggcagacagaggttgcagtgagccgagatcacgccactgcactcgggtctgggcgatagagtgagactccatctcaa

SEQ ID NO: 333249 - DNA, 141 bp, Homo sapiens
tttattgcataacatccttgtatgttggaaattcacactaaagtattcagagttattgggtcagcagcttactttcaagtggttagtaaaataagttctttcttttgtgcttgcagcttctctgtaggtttgtggttgttt

SEQ ID NO: 333250 - DNA, 174 bp, Homo sapiens
tttgagattgaccatatttgcttaatctcttatatttgtggaagacttacaggctattaatacttcaaagaactgacctccctggatcccgctgtatcttgctgggacataatcagcaggttccatcaagtctaatctacttagtgacatgaccctgggctctcatatatctaa

SEQ ID NO: 333251 - DNA, 88 bp, Homo sapiens
tctgcttaaaggagatagaaaactgttagtaaatataatttccaaggaaaataattatttagaaataagaagtgagctacgtatagga

SEQ ID NO: 333252 - DNA, 400 bp, Homo sapiens
ggcacaggaaacaaaacctaactgcagtggataaatgggcaaatggggggaaaaaaaaagcctggaggtgggggtgaggaggaaggtgatatgtgggattggctgtgtgtgagtaatgtgctaatgaggcctgcttggaatttccgggtaaatgcaagaaagaaaaaaatccctgacaaagcttcttagtgctgcacagacaatgtggctcaggaagccagatgatgccgtgaggtgccaggcatgggtgaggtagccctcctctccagccccctataatggctttagaacaaggctctttacatctacctgtaaaaggtggttggggggagtgggaggagcaccaagaggtctcagcagttgccacaggctgctttgatgatcggccaggaagatttga

SEQ ID NO: 333253 - DNA, 777 bp, Homo sapiens
gaggacaggtttcaggcctctcacacatcattggtaccatggaatatttttctcctgcaagattttgggctggccttataagaaagagaggatctgattgcaggatgtttatactcttttggggacaggacaaggttccttctgatggggcagggatgaaactcttggctggctatgccattgcagtcactgccatgtttgtggccatgtgagcaatcgtgtggttgcttatatcagtgctctccttccaccacatactcattcctcctcccatctctttctggcccctgtggtctagcttctgtccccaccagtctcccaagatgacacactttgaggaactcactggctcaggccctgtgtcctttcttgggcatcctcattcatctttcctattcagcaatccttgctgctgctcctctggccataggtcaatgtctaatcttgcttctcttctacctttatgactgctccttctctgtccatcaatggctcttgtgtctctccacttttcctggatgcttactctgtccttcattgcagactctcctcccactgagacctcaatcaccctaatggccaagtcatcagctctaatcagatatttccaatctatgctctacttttaagaagttccagcaagccaccatggcacacatttacctatgtaacaaacaggcacatcctgcacatgtatcctggaacctaaaataaagttttaaaaatgtcccatttaataagtgaaaaatggcctcttgttttaattttaaattagta

SEQ ID NO: 333254 - DNA, 350 bp, Homo sapiens
tcgttcgcctactactactaaattcgcggccgcgtcgaccgtcaagatatggtaatataatgtgaaattcctagagcagcttaatgctagtctctatttggctacctttttctttagaattgcttatatagttagtgtatgagatttttgttatattttgcaaatattttctctccattatagctcatcatcttttagctttgtttatggcatgtttttatgatagagaagtttcattttttatttttaagtggttacatctattaataatttcctttgtgtctctgaggttttgttgcttaagaaggacttctcaaagatttaaccttattttttacttaaagagcaaa

SEQ ID NO: 333255 - DNA, 816 bp, Homo sapiens
catcacccctgcatctcactccaagaagcccaatggcagttcaaaacccctcctgactctcagaacggtcaggccctcaacctttctacgcaagtcttaatgactaatgctaggcaggtaacattccagatgtctcaccacctagtccccttcagtgatctgtcacttaaaggacatgttaagtgccatctatgctcttcttgaaaaaggaatactcaactttgctttaaaaaaatatatacacaggaagtaatacttgagggtagtctattttttctgtattttttctatttatactcttttacccatataggaaaacttcaaaaaagacaatatgattttctgggctacaaaatagcatttactgaataccatttgtgaaaatattgatatgcctacaacagaaaacatctttggaaggacataccagacatttgctgtgaggagaacagtatggatagtgagtgaccagtaaggagagatttctactttaaaaaatatatttgtgtatattttcagtttcaaattaaatacacaaataagtataaaatatctactttctgaacagtgagcaggttctctgcagtatttccatcctttgacttatctctgcttttggtctccatgtgtatgttcccgactttccaactccaccagacagaggatgaataaagaggaagctccaggctgtgaagcgtctagtccttgctcccctcagaagctgggacatgttggaccaaggtggtaaggatagtgaggtatggctttaccttgtacaattcaaaacaatcatattccttgactcagcaattctat

SEQ ID NO: 333256 - DNA, 2358 bp, Homo sapiens
catcacccctgcatctcactccaagaagcccaatggcagttcaaaacccctcctgactctcagaacggtcaggccctcaacctttctacgcaagtcttaatgactaatgctaggcaggtaacattccagatgtctcaccacctagtccccttcagtgatctgtcacttaaaggacatgttaagtgccatctatgctcttcttgaaaaaggaatactcaactttgctttaaaaaaatatatacacaggaagtaatacttgagggtagtctattttttctgtattttttctatttatactcttttacccatataggaaaacttcaaaaaagacaatatgattttctgggctacaaaatagcatttactgaataccatttgtgaaaatattgatatgcctacaacagaaaacatctttggaaggacataccagacatttgctgtgaggagaacagtatggatagtgagtgaccagtaaggagagatttctactttaaaaaatatatttgtgtatattttcagtttcaaattaaatacacaaataagtataaaatatctactttctgaacagtgagcaggttctctgcagtatttccatcctttgacttatctctgcttttggtctccatgtgtatgttcccgactttccaactccaccagacagaggatgaataaagaggaagctccaggctgtgaagcgtctagtccttgctcccctcagaagctgggacatgttggaccaaggtggtaaggatagtgagtttcccagaagctggacaagccacgacggcgccttccaataaaaggggaactccagagacgctatgagaaaagaggaacagacatctgcaatagatatctgcaacttccttttcaaaaacaccatcggcattgctttctcaggaagccactgccagcctattgtgatagctgacactgagttcctgagaattctctaattaggatcccagattggagggtcagccagtggttaacatataatggacacaaaactgattttactggaagactgagggtgggcactcaccatggttctaagcattcattactcagaagatccataaaaacattacagttctgttgtgtaagagtttaggaaaaaaagaaaatcctgacaaaaatcccaacctaaaaaacagtgtcaacatttgtaagtaggatggggaggcagagatgaattggcagtgttatcacagctactggactatgtggactttaacaaagtaagaaacgggtgggggttgggtggtggtatcttaatagagcaggagtagagacggatgtcctggggcagaatgggtaccaatgctgcctgaagcctggagctgggagctgaggactaagaggtagacaggagggtggggaccggtacctgctccaaggaactggtgccccagaactggtgagctggggtatgcatttagctcattcgtttaccagaatgcagtcaccacctgatgaaagaaatgactaatggcaggacttgaacagttctctataaatgagtacctgggagaaaaacaggtctccaggctccacaatacccaataaacacactgcctttagcccacttcaagctgcacttcttacatggaacccaacccaaccaacctcagaggtaagggtgagagcaggcaatgaacagctatgattctccattccctggccaggcagggagcctttccatccaccctcgtgagactgcttgtaacagaaataaggaaaccgactccaaggctcagtaacccacccaaggtcagaaccacggagtggcagggcctgtgagccacaaaggagactgaaaaccagaaagagcttctctctggtctgttattttaagaaaaacatgcccagaggggccacctggaagcaaggctgtgtggcaccctcaccttcctaattaaacaacaacttcccaggagcaacgacagcaacaacagcctggcccagcagatgaactcgaatcaatccaagcccttcccctatacgggtcagtttgggcactactttacctgctgtgaagtctactgggatcttccaggaaagtcccacctcattaagtaaaaagaaaaacaaagactcgggaagaaagttctgccctccctgttgaatgctgtgtgaggataagatgtctggagcatggcagtcaccctgtgactatcagaaggccaggcgtaccacaaggtggtcattccagtgctctgaatcagccccaaaccacttccctcaagactcatgttctgaggtgattaaaagtgtgctttgaaggtaaatctaggatgacagtcaacagatcagtgattgccaggagtcaggggtagagggagggaagaacagatg

SEQ ID NO: 333257 - DNA, 2110 bp, Homo sapiens
tccaccgcgccacaggagcgaggtccaacgcaacggtccctagggcctgcctccaacccagcctcagtttcctatctgtcacatcgttctatgatctcgaaatgactataacccctttcttagccccaaaccagccggaagcgacatcttccggttgctacaggttacggcggttgctatgggctacggcgcctgcgcagaaacaccgccaagcgactcagcaacttctagagcgcatgcgtttcgcccacccaggcccgggcgcggttaggggtgactcccacgatccctagcggctgcagagtggaacatggcggcctccttgccgcttgcgttaccagagtccacccggcctcgtgctttctccgggcgcccgtagctggcgccggcatccacaaaaatagatcagacagaggatgaataaagaggaagctccaggctgtgaagcgtctagtccttgctcccctcagaagctgggacatgttggaccaaggtggtaaggatagtgagtttcccagaagctggacaagccacgacggcgccttccaataaaaggggaactccagagacgctatgagaaaagaggaacagacatctgcaatagatatctgcaacttccttttcaaaaacaccatcggcattgctttctcaggaagccactgccagcctattgtgatagctgacactgagttcctgagaattctctaattaggatcccagattggagggtcagccagtggttaacatataatggacacaaaactgattttactggaagactgagggtgggcactcaccatggttctaagcattcattactcagaagatccataaaaacattacagttctgttgtgtaagagtttaggaaaaaaagaaaatcctgacaaaaatcccaacctaaaaaacagtgtcaacatttgtaagtaggatggggaggcagagatgaattggcagtgttatcacagctactggactatgtggactttaacaaagtaagaaacgggtgggggttgggtggtggtatcttaatagagcaggagtagagacggatgtcctggggcagaatgggtaccaatgctgcctgaagcctggagctgggagctgaggactaagaggtagacaggagggtggggaccggtacctgctccaaggaactggtgccccagaactggtgagctggggtatgcatttagctcattcgtttaccagaatgcagtcaccacctgatgaaagaaatgactaatggcaggacttgaacagttctctataaatgagtacctgggagaaaaacaggtctccaggctccacaatacccaataaacacactgcctttagcccacttcaagctgcacttcttacatggaacccaacccaaccaacctcagaggtaagggtgagagcaggcaatgaacagctatgattctccattccctggccaggcagggagcctttccatccaccctcgtgagactgcttgtaacagaaataaggaaaccgactccaaggctcagtaacccacccaaggtcagaaccacggagtggcagggcctgtgagccacaaaggagactgaaaaccagaaagagcttctctctggtctgttattttaagaaaaacatgcccagaggggccacctggaagcaaggctgtgtggcaccctcaccttcctaattaaacaacaacttcccaggagcaacgacagcaacaacagcctggcccagcagatgaactcgaatcaatccaagcccttcccctatacgggtcagtttgggcactactttacctgctgtgaagtctactgggatcttccaggaaagtcccacctcattaagtaaaaagaaaaacaaagactcgggaagaaagttctgccctccctgttgaatgctgtgtgaggataagatgtctggagcatggcagtcaccctgtgactatcagaaggccaggcgtaccacaaggtggtcattccagtgctctgaatcagccccaaaccacttccctcaagactcatgttctgaggtgattaaaagtgtgctttgaaggtaaatctaggatgacagtcaacagatcagtgattgccaggagtcaggggtagagggagggaagaacagatg

SEQ ID NO: 333258 - DNA, 1759 bp, Homo sapiens
tatagcctggtggtggcagtccagagtgcaacccctagagatggtaacttgacaagacctctcaaaaacactacacacagcttttgagcccctcatcccacttctgagagtaagtcctatggcaacatgtgcacacgtggaaaatgaagtctgtacaagtttcccagaagctggacaagccacgacggcgccttccaataaaaggggaactccagagacgctatgagaaaagaggaacagacatctgcaatagatatctgcaacttccttttcaaaaacaccatcggcattgctttctcaggaagccactgccagcctattgtgatagctgacactgagttcctgagaattctctaattaggatcccagattggagggtcagccagtggttaacatataatggacacaaaactgattttactggaagactgagggtgggcactcaccatggttctaagcattcattactcagaagatccataaaaacattacagttctgttgtgtaagagtttaggaaaaaaagaaaatcctgacaaaaatcccaacctaaaaaacagtgtcaacatttgtaagtaggatggggaggcagagatgaattggcagtgttatcacagctactggactatgtggactttaacaaagtaagaaacgggtgggggttgggtggtggtatcttaatagagcaggagtagagacggatgtcctggggcagaatgggtaccaatgctgcctgaagcctggagctgggagctgaggactaagaggtagacaggagggtggggaccggtacctgctccaaggaactggtgccccagaactggtgagctggggtatgcatttagctcattcgtttaccagaatgcagtcaccacctgatgaaagaaatgactaatggcaggacttgaacagttctctataaatgagtacctgggagaaaaacaggtctccaggctccacaatacccaataaacacactgcctttagcccacttcaagctgcacttcttacatggaacccaacccaaccaacctcagaggtaagggtgagagcaggcaatgaacagctatgattctccattccctggccaggcagggagcctttccatccaccctcgtgagactgcttgtaacagaaataaggaaaccgactccaaggctcagtaacccacccaaggtcagaaccacggagtggcagggcctgtgagccacaaaggagactgaaaaccagaaagagcttctctctggtctgttattttaagaaaaacatgcccagaggggccacctggaagcaaggctgtgtggcaccctcaccttcctaattaaacaacaacttcccaggagcaacgacagcaacaacagcctggcccagcagatgaactcgaatcaatccaagcccttcccctatacgggtcagtttgggcactactttacctgctgtgaagtctactgggatcttccaggaaagtcccacctcattaagtaaaaagaaaaacaaagactcgggaagaaagttctgccctccctgttgaatgctgtgtgaggataagatgtctggagcatggcagtcaccctgtgactatcagaaggccaggcgtaccacaaggtggtcattccagtgctctgaatcagccccaaaccacttccctcaagactcatgttctgaggtgattaaaagtgtgctttgaaggtaaatctaggatgacagtcaacagatcagtgattgccaggagtcaggggtagagggagggaagaacagatg

SEQ ID NO: 333259 - DNA, 2304 bp, Homo sapiens
catcacccctgcatctcactccaagaagcccaatggcagttcaaaacccctcctgactctcagaacggtcaggccctcaacctttctacgcaagtcttaatgactaatgctaggcaggtaacattccagatgtctcaccacctagtccccttcagtgatctgtcacttaaaggacatgttaagtgccatctatgctcttcttgaaaaaggaatactcaactttgctttaaaaaaatatatacacaggaagtaatacttgagggtagtctattttttctgtattttttctatttatactcttttacccatataggaaaacttcaaaaaagacaatatgattttctgggctacaaaatagcatttactgaataccatttgtgaaaatattgatatgcctacaacagaaaacatctttggaaggacataccagacatttgctgtgaggagaacagtatggatagtgagtgaccagtaaggagagatttctactttaaaaaatatatttgtgtatattttcagtttcaaattaaatacacaaataagtataaaatatctactttctgaacagtgagcaggttctctgcagtatttccatcctttgacttatctctgcttttggtctccatgtgtatgttcccgactttccaactccaccagacagaggatgaataaagaggaagctccaggctgtgaagcgtctagtccttgctcccctcagaagctgggacatgttggaccaaggtggtaaggatagtgagtttcccagaagctggacaagccacgacggcgccttccaataaaaggggaactccagagacgctatgagaaaagaggaacagacatctgcaatagatatctgcaacttccttttcaaaaacaccatcggcattgctttctcaggaagccactgccagcctattgtgatagctgacactgagttcctgagaattctctaattaggatcccagattggagggtcagccagtggttaacatataatggacacaaaactgattttactggaagactgagggtgggcactcaccatggttctaagcattcattactcagaagatccataaaaacattacagttctgttgtgtaagagtttaggaaaaaaagaaaatcctgacaaaaatcccaacctaaaaaacagtgtcaacatttgtaagtaggatggggaggcagagatgaattggcagtgttatcacagctactggactatgtggactttaacaaagtaagaaacgggtgggggttgggtggtggtatcttaatagagcaggagtagagacggatgtcctggggcagaatgggtaccaatgctgcctgaagcctggagctgggagctgaggactaagaggtagacaggagggtggggaccggtacctgctccaaggaactggtgccccagaactggtgagctggggtatgcatttagctcattcgtttaccagaatgcagtcaccacctgatgaaagaaatgactaatggcaggacttgaacagttctctataaatgagtacctgggagaaaaacaggtctccaggctccacaatacccaataaacacactgcctttagcccacttcaagctgcacttcttacatggaacccaacccaaccaacctcagaggtaagggtgagagcaggcaatgaacagctatgattctccattccctggccaggcagggagcctttccatccaccctcgtgagactgcttgtaacagaaataaggaaaccgactccaaggctcagtaacccacccaaggtcagaaccacggagtggcagggcctgtgagccacaaaggagactgaaaaccagaaagagcttctctctggtctgttattttaagacctaattaaacaacaacttcccaggagcaacgacagcaacaacagcctggcccagcagatgaactcgaatcaatccaagcccttcccctatacgggtcagtttgggcactactttacctgctgtgaagtctactgggatcttccaggaaagtcccacctcattaagtaaaaagaaaaacaaagactcgggaagaaagttctgccctccctgttgaatgctgtgtgaggataagatgtctggagcatggcagtcaccctgtgactatcagaaggccaggcgtaccacaaggtggtcattccagtgctctgaatcagccccaaaccacttccctcaagactcatgttctgaggtgattaaaagtgtgctttgaaggtaaatctaggatgacagtcaacagatcagtgattgccaggagtcaggggtagagggagggaagaacagatg

SEQ ID NO: 333260 - DNA, 1228 bp, Homo sapiens
gttggtttctgtattactatctgttcagacacaagcgtccttaaaaatgtgcttagttgtaatttcttcatagatttcaaccaaaacaacatattgcaagattgaatgcagaagtagatgtgagaactcattctattaagccaagcgtaaatgtttaaaaatgtaaaataataccactcttctgatatgttttgggagaaaatatgtttgtggaaaatatacctatcaaagaaatatcagaaaccttccaaactgaaggacatgtgtatccagattaaaatgaccttccaaatgcttaacatagtaaacaaaaaacaggaggaaaaggaggggagaaaagaaaaaaagaagactcacacaaggccgtgttacgacatttcatcataccatagataaatcagatcctgaaagatttcagaaaggaatatgagatcacacataaaggaacaggaatcaaaatgacattacccttctcaacaacactggaagctccaagagagtgcagcaatgctttcatcctcagagaaaataattatcaatacaaaataatattcccagctaagctatcaatcatgagggtagaagaaaggcatttttagccattgcgtgggagtgctataataatggtcccagtgaaccacacctccctgtatccgcaccactttgcaatgagaaatttgctgtttctcctagtgagagagggagtctatttctttacccttgggcctgggctggcctggtgacttgttttgaccaatacatggaagaagtgacattatgtgagttctgcagctgaagctttaagaggccttgaagtttctcctcaccttcttggaaccttgagaccaccatgctgtgagaagcctgggcatatctactggaggccgaggggccacatgacacgtctaaaactcatacgtcaagatatggtaatataatgtgaaattcctagagcagcttaatgctagtctctatttggctacctttttctttagaattgcttatatagttagtgtatgagatttttgttatattttgcaaatattttctctccattatagctcatcatcttttagctttgtttatggcatgtttttatgatagagaagtttcattttttatttttaagtggttacatctattaataatttcctttgtgtctctgaggttttgttgcttaagaaggacttctcaaagatttaaccttattttttacttaaagagcaaa

SEQ ID NO: 333261 - DNA, 1586 bp, Homo sapiens
tccaccgcgccacaggagcgaggtccaacgcaacggtccctagggcctgcctccaacccagcctcagtttcctatctgtcacatcgttctatgatctcgaaatgactataacccctttcttagccccaaaccagccggaagcgacatcttccggttgctacaggttacggcggttgctatgggctacggcgcctgcgcagaaacaccgccaagcgactcagcaacttctagagcgcatgcgtttcgcccacccaggcccgggcgcggttaggggtgactcccacgatccctagcggctgcagagtggaacatggcggcctccttgccgcttgcgttaccagagtccacccggcctcgtgctttctccgggcgcccgtagctggcgccggcatccacaaaaatagatcagaccctgagagcctactgaccacagcagctcctgttaccacggctgccgtttctgctctcaatgctactgctcattgatcccagggaggaaaattctggtgcatcacttagtatttatttcagatttcaaccaaaacaacatattgcaagattgaatgcagaagtagatgtgagaactcattctattaagccaagcgtaaatgtttaaaaatgtaaaataataccactcttctgatatgttttgggagaaaatatgtttgtggaaaatatacctatcaaagaaatatcagaaaccttccaaactgaaggacatgtgtatccagattaaaatgaccttccaaatgcttaacatagtaaacaaaaaacaggaggaaaaggaggggagaaaagaaaaaaagaagactcacacaaggccgtgttacgacatttcatcataccatagataaatcagatcctgaaagatttcagaaaggaatatgagatcacacataaaggaacaggaatcaaaatgacattacccttctcaacaacactggaagctccaagagagtgcagcaatgctttcatcctcagagaaaataattatcaatacaaaataatattcccagctaagctatcaatcatgagggtagaagaaaggcatttttagccattgcgtgggagtgctataataatggtcccagtgaaccacacctccctgtatccgcaccactttgcaatgagaaatttgctgtttctcctagtgagagagggagtctatttctttacccttgggcctgggctggcctggtgacttgttttgaccaatacatggaagaagtgacattatgtgagttctgcagctgaagctttaagaggccttgaagtttctcctcaccttcttggaaccttgagaccaccatgctgtgagaagcctgggcatatctactggaggccgaggggccacatgacacgtctaaaactcatacgtcaagatatgcttgaaagctgcacccatcaagtgcgtcctgaatctgacgattcactatcttcacttccgccagtctgctccaggcctccatcctttctggcctaaatgaaccccaaagctggcttgtgtcctgcatccatccaccactcttgcccttgtttcacttatctattgctgtgaaataaacttcaaaaccaagtgattcagt

SEQ ID NO: 333262 - DNA, 699 bp, Homo sapiens
tcactatcctatgctcttgcctgacagaccctgagagcctactgaccacagcagctcctgttaccacggctgccgtttctgctctcaatgctactgctcattgatcccagggaggaaaattctggtgcatcacttagtatttatttcaggtatggttaggacatttcagaataaaggatggcttcttctggatgtatctgaattgatctgctgtcatatacttatgaatcacatgctcagaccaaagtacataaaaaagtcattctctttccagacaattttaggggtttgtaaccttggtcttatattgctccatggcctatgaattagtaacaggactagtgaaattcctagtaacatagtcctgttactacaagattacccatatcctttgatgatccatctactgcaaactcatagaatttactggacagtcttcttcattttatgtaagaatgaccactgtatcatcatatgtcaatgtcctgcataactgtcaccacccctccatgccgaatacctggtagcttgtgatgagttgagaacctcactaaacagtcttatccacatcctcaggttctctgaggttttccttctgtccagtccatgcacttgtacccctggtggtcgaagtacagtcacgcactgcgtatgatgttctcatcagtggtgggctgcatacacagcagtggtcccata

SEQ ID NO: 333263 - DNA, 1686 bp, Homo sapiens
tccaccgcgccacaggagcgaggtccaacgcaacggtccctagggcctgcctccaacccagcctcagtttcctatctgtcacatcgttctatgatctcgaaatgactataacccctttcttagccccaaaccagccggaagcgacatcttccggttgctacaggttacggcggttgctatgggctacggcgcctgcgcagaaacaccgccaagcgactcagcaacttctagagcgcatgcgtttcgcccacccaggcccgggcgcggttaggggtgactcccacgatccctagcggctgcagagtggaacatggcggcctccttgccgcttgcgttaccagagtccacccggcctcgtgctttctccgggcgcccgtagctggcgccggcatccacaaaaatagatcagaccctgagagcctactgaccacagcagctcctgttaccacggctgccgtttctgctctcaatgctactgctcattgatcccagggaggaaaattctggtgcatcacttagtatttatttcagatttcaaccaaaacaacatattgcaagattgaatgcagaagtagatgtgagaactcattctattaagccaagcgtaaatgtttaaaaatgtaaaataataccactcttctgatatgttttgggagaaaatatgtttgtggaaaatatacctatcaaagaaatatcagaaaccttccaaactgaaggacatgtgtatccagattaaaatgaccttccaaatgcttaacatagtaaacaaaaaacaggaggaaaaggaggggagaaaagaaaaaaagaagactcacacaaggccgtgttacgacatttcatcataccatagataaatcagatcctgaaagatttcagaaaggaatatgagatcacacataaaggaacaggaatcaaaatgacattacccttctcaacaacactggaagctccaagagagtgcagcaatgctttcatcctcagagaaaataattatcaatacaaaataatattcccagctaagctatcaatcatgagggtagaagaaaggcatttttagccattgcgtgggagtgctataataatggtcccagtgaaccacacctccctgtatccgcaccactttgcaatgagaaatttgctgtttctcctagtgagagagggagtctatttctttacccttgggcctgggctggcctggtgacttgttttgaccaatacatggaagaagtgacattatgtgagttctgcagctgaagctttaagaggccttgaagtttctcctcaccttcttggaaccttgagaccaccatgctgtgagaagcctgggcatatctactggaggccgaggggccacatgacacgtctaaaactcatacgtcaagatatggtaatataatgtgaaattcctagagcagcttaatgctagtctctatttggctacctttttctttagaattgcttatatagttagtgtatgagatttttgttatattttgcaaatattttctctccattatagctcatcatcttttagctttgtttatggcatgtttttatgatagagaagtttcattttttatttttaagtggttacatctattaataatttcctttgtgtctctgaggttttgttgcttaagaaggacttctcaaagatttaaccttattttttacttaaagagcaaa

SEQ ID NO: 333264 - DNA, 370 bp, Homo sapiens
tgcatgcctgtggtcccagctactcgagaggctgaggtcaggctgaggtgggaggatccctggagcctgggaagcggaggttgcagtgggggatgaaaaagaataccccgtgtccaaatagcaaaacactctgaaatgaggcaaaccgtggtttgttgaacaggtgttctgggacaaggttgccgaatatgcattagccgtaatccccaggacagccatgcagggtgggtcttaaacagttttttagattctcgagtataaaggtataatattgaagaataagcacaaataatgtcatcatacatgttaaagtgacaacacaggatttacaaaattacccttttttccccaaattacctcttacgatgtg

SEQ ID NO: 333265 - DNA, 265 bp, Homo sapiens
gtgggatattaagtggggcttccttggaggcaggcggggcctcaggttcggctgtgttgggtcactccctgtcccgccccggcctctggagtttgtgtggttttgtctcctctttcttcctggatcattgtgcatgaggctgggagccacaccggctgcttaggctcctcctgcctcccaggccacctgcaggtcacaggggctgatgaagccgtgaatcgcttggctctgtttggaatgctcgttccccggtgccataaagaaa

SEQ ID NO: 333266 - DNA, 2205 bp, Homo sapiens
ctcgacccacgcgtccgcgcgccccaggagccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccccgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacgggttgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtacctttttttttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctga

SEQ ID NO: 333267 - DNA, 1924 bp, Homo sapiens
ctcatgtgatcagggcgcctggcctattgaaggtttttaatcttcagagtttcgactttatcaacaacacttagaagccaccaaagaattgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacgggttgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtacctttttttttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctga

SEQ ID NO: 333268 - DNA, 280 bp, Homo sapiens
taaaattatttttcctttttatttcaggaattacaacatatcgttggatcacagcacatcagagcagagaaaggtaagcatggatccatacatctgtatgaaatcccacagggtcactactattttggctataataatatggtttctctcatctccagcgatggtggatggctcatggttagatctggccaagaggagcaagcttgaagctcagccttttgctcatctcactattaatgccaccgacatcccatctggtaagctctatctgcatccagcc

SEQ ID NO: 333269 - DNA, 2159 bp, Homo sapiens
ctcgacccacgcgtccgcgcgccccaggagccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccccgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacgggttgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtacctttttttttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctga

SEQ ID NO: 333270 - DNA, 953 bp, Homo sapiens
ttgcctgagctttcctcagggactcagatcagggctggcagtagatggtaggctctccagtctcaaagctgtggccgccttcagaccacaccacctctaccattattttctgtccgacatgttcaaactgttcctgcattatatctacccaagttcccagggaaaagtccccattgtccttgatgaatggatgatctgtcattgccatgatggtcatacagacacaaatcaaagaaataggctgggcgtggggctcacacctgtaatcccagcactttgggaggccgaggaaggaggattacctgagcccaggagttcgagaccagcctgggcaacatggcgagaccctgtctctacaaaaaattagctagtcatggtgggcatatctgtagtcccagctatgtgggaggctaaggtgggaggatcgtttcagcctgggaggtcaaggctgcagtgagctgtgatggcgtcagtgttctccagcctgggcaacagagtgagtccctgtctccaaaggaaaaaaaaaagaaaaaagttttgtcattttgatcacatcatctcactgattctctcagcctcaatttccctatctgtaaaatgagtgtattaaactggatcagtggtttcctcctccattttgcaaagctctctcctaggacacagctaggacttttcgggaagggggcagagtgagagaggacaaggccaaagctttcttttgaaaagagactcctgtttgaaagccatgactatgtgattctgaggttgcatgcccatccttgtatttgagaagcttcctatgcaggaaaaactggtgaaataatatacagatcaagcctgagagtctctgataaaatattaatatcatcaatcactgtatagatataaactttggtatctgtctagagagagatacagatgatattaggttccattaatgctttgaaatttac

SEQ ID NO: 333271 - DNA, 318 bp, Homo sapiens
tctgataaaaggtatccacaaaaaacctagattagaaaggtacttagtggtgaaaacttcccctttaagagtgaggcttagttaatagggttgctcctaaaaataagaataaaaaaaagggaggaacaagagcaggaagctctacagttctaggcagcatattagacaagaaaaagtaacaaaagttgtaagaattagaaaagaagaaacaatctgtcattatttgcagatgctatattcctaattagaaaaccaaaaagggctggacgcagtggctcactgtaatcccagcactttgggaggccaaggcaggcagat

SEQ ID NO: 333272 - DNA, 272 bp, Homo sapiens
gctttgacctcgaacggccatggtttcacttgcacgctctcccacttaccatttaaccttcagcaaccagtttttcattccatcagcaggtgcctaggcaggctgagggagcacttaggtggagtaaacgagttactatatgcttagcacaaagtaagcacttgataaatgtttgcttttattattattactattatcttgagggggacagagtcccactccgtcgcctaggctgcagtgcagtggcaagatctcggctcgctgcaatctcc

SEQ ID NO: 333273 - DNA, 180 bp, Homo sapiens
ctcctagattcctcacatgtgcagttcacaatagggttctcctatgagaatctaatgctgttgctgatgggacaggaggcagagctcgggcagtaatgcgagtgactcccgctgctcacctcctgctgtgtagcctggttcctaacaggccatgaactggtacaggcccatggcccgggg

SEQ ID NO: 333274 - DNA, 4355 bp, Homo sapiens
agcgggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaagaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgta

SEQ ID NO: 333275 - DNA, 4811 bp, Homo sapiens
agcgggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaagaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgtagaatatttctcttctttaaaatggcttctattcataaaaaaaaaaaaaaaaaaaaaaaaaaaaaaaaaaaaaagaaaacaaaaaaaaaagaaaagaaagaagagagaaaaaaaaaagaaaaaagagaaaagggggggggggggcaaaaaatactccccgggggggggcccatttgcccccgccttttattttgaaaaagggggggcccccaaggggggtttataacaaagcaggcacgcgcgcggcgcggctattaaaaacacgcccctttgcgggggaggacaaaactgcgtcgtgtgggtgtctccttcttgttgagagcacaccaccatcgtgggggggggagcaaacatttgcgcagcccaccccgcctcacgtaattttataccctcgcgggaataatcacaatcatggcgtgtttattgttttaaacccgccttattgtctgcgggagaa

SEQ ID NO: 333276 - DNA, 4297 bp, Homo sapiens
agcgggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaagaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgtgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgta

SEQ ID NO: 333277 - DNA, 4229 bp, Homo sapiens
agcgggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaagaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgta

SEQ ID NO: 333278 - DNA, 3874 bp, Homo sapiens
tcccatgtgtcctaccttactccccctaaaaaatatatggtcatgcagttggggctaaaagagctattgggaggctgaggcaggagaatggattgagcttgggaggccgaggttgcagtgagccaagattgtaccactacactccagcctgggtgacagagcagagactctgtctcaaaaaaacatacatagtttattgttaattcgtctaggttttaataattttcataggaaaaaaacttgtatatagtttattttcttttaattatattttttaagaagtagaatatcaactaaattttttttctgtttagtgacgagacctgcagtgtcaacatttttattaatttttgggtaaaaatgtatattctataataatagtgataacttgcaaaagttcaattctgaacattgttggagtgattaaatttaaaagtgtaatgaattttggttttcctttgttcatttattatggcaaatatgtctgacacacacacacaccctttaaataataggaaataaaatcaaatatcaaattcccattctttttaaaaaagttttatagaatttaaataaaaaccacaatatggcattggtaataatttaggatgtgattgaaatgaaaagcctttgagtcttcttttttacttaaaaaatttttagatttatgttaaaagaatcattgtcttctttcagataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgta

SEQ ID NO: 333279 - DNA, 3097 bp, Homo sapiens
agcgggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaagaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgc

SEQ ID NO: 333280 - DNA, 1416 bp, Homo sapiens
ttcatactgatcagaattaaatttgtttagtgctatttacattcattttaaaactctgctctatacaaatttaattctgatcagtatgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgta

SEQ ID NO: 333281 - DNA, 2375 bp, Homo sapiens
agcgggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaagaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatgggtgagtgatatttttctcttgagtatgaataatgttgattcttatgccctaccttgtctcacaaacattttgaaactgttatataacatttaaaagaacaaccgaaaattgagagtataaggctcagatttagaggatcattgtacccttccttatcttgctcttcagcagtctcattcccaaatggtaaaggagcccagaatgcaatggctctgcttctgtctcaaaaaaaaaattgcctccctcaagtgaattgttggtttattttcttcctttgaacttccccagtgtcatcttgatccttatgtcatgtatcatagtgatatgatttttttcagctgatttcacttaattttattagcagtagcaatttgaacttttaaaggacaagacttattttgacaaagaacatagtatatgtacaaaatgagtcaattagattagtgtttctcaaccttaaataatatacggagcttttctagaggaagataattcttgtagatctctagttgctgacttaaattatttttattataatgcgtattttaaaatgtagaaacttaaacccagttaaaactctttattcttcttaactcatatacacaatcataaaactaaaaaagattgattcagagttatatttgcatataactctgaaaccaataatgttcaagttaacaacattaatgtgctagatgatgtatttttgccaaagccagctcactgcttacagcatgaatactgttgagtttgtcatgcctatgttcctacatagtgtttgatgaccaggttgtctgtagagtcaccataaaacctttatttatacagtataacaaattgttactcagttttctcataggtagaatgcatcatttacttgttaagtgaacccctgttctgatctcattagcctcctaacaattaaagaagtactgactgcttggcaccagtacagtcataaatttaatgcacacgtgagtactaaaaccccaaggctgcacttgggttataaagtcactatttaaatcatctagacaatctcctccagatttcattaaaatgaaaatacagattttccagattttcatt

SEQ ID NO: 333282 - DNA, 788 bp, Homo sapiens
  misc_feature (10)..(10): n is a, c, g, or t
  misc_feature (17)..(17): n is a, c, g, or t
gatccaccgngatccancgttggatccggttggatcgaatttgggatccaaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgtagaatatttctcttctttaaaatggcttctattcataaaaaaaaaaaaaaaaaaaaaaaaaaaaaaaaaaaaaagaaaacaaaaaaaaaagaaaagaaagaagagagaaaaaaaaaagaaaaaagagaaaagggggggggggggcaaaaaatactccccgggggggggcccatttgcccccgccttttattttgaaaaagggggggcccccaaggggggtttataacaaagcaggcacgcgcgcggcgcggctattaaaaacacgcccctttgcgggggaggacaaaactgcgtcgtgtgggtgtctccttcttgttgagagcacaccaccatcgtgggggggggagcaaacatttgcgcagcccaccccgcctcacgtaattttataccctcgcgggaataatcacaatcatggcgtgtttattgttttaaacccgccttattgtctgcgggagaa

SEQ ID NO: 333283 - DNA, 4374 bp, Homo sapiens
agcgggagggaggacgaggacgggggcggcggctgctgcgagggggggcccgggtatctgcttgtgttccttttatctgagggttgatgtcgacgctcggcgtagttgtggtcatgatcggtttgcctagtgcttgaagaatcgtgagtgccggctcacgagagttgctgcggcaatgatacgatgaaggaggaggaggagaaacaaagctctgagaagaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgta

SEQ ID NO: 333284 - DNA, 4301 bp, Homo sapiens
agcgggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaagaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgta

SEQ ID NO: 333285 - DNA, 3151 bp, Homo sapiens
agcgggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaagaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgc

SEQ ID NO: 333286 - DNA, 105 bp, Homo sapiens
gttttttttttttacttatgttggcaaagtttgttactgggacacgttcatatactgatggtaatgatggaggaaggaagaggggtgcaggtggggctgcctcca

SEQ ID NO: 333287 - DNA, 364 bp, Homo sapiens
tgaactaggcaggtgggcattcccagcagagggaccagcagatgcaaaggcaggaggtagcaatcagtgaagaatgttcaggaaacacaacaggtcatggagcgcagtctaagatgtgtgtgcaggagtagcaagaggagacgccagaaaatgaggccggggcagatcccaaattgtgcataagtcatgctgaagcatcacgcttggtacggcaggcatccgtatgggagccccttaagaatttgatctgatctacattttcctaaaatccccctgggtaggtgcctggtaaatggacaggcagaggaacagaggaaggaggtggccagctggaggtgggtcaaatggtcagggaagagatgac

SEQ ID NO: 333288 - DNA, 559 bp, Homo sapiens
ggatgatactggttgtctagaataagaaacaaaatacaagatttccctgtgcttggcatagaacaatctaaacgcagggcctgatggagcatgtaggttgttgaggatggttggatttcttgttcatctaaagctgtcaaggaggctgggagccaagggaataaaaggcactgcttaatgagttctaatagaagttaacaggtaactttcacagtgatgctagaagtagatgtaatccctctccattatatggcaataataaggaatacttttttctcattccgtgtgtgctctggagagggaaaaaaagcagttgatgttgctgctcagcatcctctcagagcggcatcataaaactcagtccttatattagcaaggttcaatcagacccatgaaatgagggcagcattaaaagaggtgtttcgatgagggatagaggcgggacagtgggagcattgtaagcgtttaatcaggtcacaattgcacttcatcctagggctgccatgggagatctgagttaggcagctgggagtaccaaagaggcatggctccaaaattg

SEQ ID NO: 333289 - DNA, 427 bp, Homo sapiens
tctggcttaaacatggtatttaatagaatctcagtaagtgttgttgatgaatgaaagcagaaaagaatgaatgaatgatatgtggaaaggaaagaaattagaaaggaagaaaggaaggaaagaatgaaagcagggaaaaagaaaggaaaaaatggaggtaaggaaagaatgactcattcaataactaaataaaggaatgatcaattttcaattagtctttgattgatgctattatgttacatgtcaggcttccatacaaaatctgttattttggaaactaatcattcaagattccaagaatttaataaactctcccagcattttctttctgtgtctctttttatagactggagaggcagatttaggtatttttgacaatgaaactaagcaggaggatcaagtccagattgttagggcccttgggata

SEQ ID NO: 333290 - DNA, 559 bp, Homo sapiens
aagaaagaaggaaggaaagaaggaaggaaggaaaagaaagaagaaaggaagaaagaaagaaagaaaagaaagacttaaccaatctttgtatctcagtgtgtttagcacattataagtgctcaataaatgttcactatataaatgaattttgaaacttctctttggcagtaagtagccttttgtttgttgccttccttccttctttccttccttctttctctttctttcgaaagaaaggaagaaaggaaggaaagaatgaaagcagggaaaaagaaaggaaaaaatggaggtaaggaaagaatgactcattcaataactaaataaaggaatgatcaattttcaattagtctttgattgatgctattatgttacatgtcaggcttccatacaaaatctgttattttggaaactaatcattcaagattccaagaatttaataaactctcccagcattttctttctgtgtctctttttatagactggagaggcagatttaggtatttttgacaatgaaactaagcaggaggatcaagtccagattgttagggcccttgggata

SEQ ID NO: 333291 - DNA, 555 bp, Homo sapiens
tggcttcaggggatgaaatgattatccagtggaagttgtagagaggcagatttccacctgcctcaaatgtagggaagaactgataggacctcaagataatatgacctgttatatgaggtagtaagtgggaggtacacatttatggcatgagttcaagcagaggctggataaagtacagagtatttgtttctaacattccttcagctctaagattctattgatcttagttaacagagacacatacatgttgatgagacatgatgaaatcagctagacaccacctcatcaaacagtgttaacatggctggcatgcattaaatatcttcagaaaagctgaggttgtaatttttctgaaagtgattttactatgcaacatcagcccatggtgagactccgtacagtaaaatgtaaatctaaagaccttgaggacatccaacagaaactaaagaactgtgacccaaattaggattgtgattgaatatcctttatgcaccaagcaatagtgcatggtatcattccatgtttgcaaactccaaagagatcagggataaaaat

SEQ ID NO: 333292 - DNA, 902 bp, Homo sapiens
attccagatccttctctcctgagagttcttcagaatatcatgggtagtgtttttatctagatacttagcagttgctggccattatgtttcagtagattttttcaataatttaaaaggatcctaagctctaagtaaagctattgccaaatattttcatttgctaaagcaacatttgcaagccagctaatatttaaaagacagcaaaaagaagagagactttgtacatccatagatgttttaacattacaagaggattttagaaaaacatttggtattgatgtatggtgaaaatcagatggttttatctaacagttgaaactgattacttgttaaatctttattccatcctgcttcttgattataataggcacaaaattctgtaatgaacaaagaatgagtacttttccgtttaattttgcatactagctaaaatttttctttttaaaataacttcaaggaaaaatggggtcaaccctgggctatgagattttgtactagtttattcaaacagattccttttctcctttgcaagtggagcacagtgtccatagacctagatggaaaataatctttgaggaaaaacaaggttttatttaaagaattacgcaggttgacatagtttaaactttggatgcccctctgaataaattgtatgtaaaataacgtagctatttaaaataacatgatttcccttatctcataatctaaaataagaatttctaagagtggttgagggaagggagtaggaaaagaaaagcattttttgtttgtttttgtcaaaattgttttaacattcacctcagaagctgtatatacatttcattcatataacccttaaagaaagcatttagctggccaaatctttgcatgtttatttaacatctatgaatacatccatatgt

SEQ ID NO: 333293 - DNA, 299 bp, Homo sapiens
atggggtctgtagggaactggagcagatgaagaagaggccccagggtggagaggcccaagggtgggcctagagagctctctcaaccctcaggagaaggaataattctcaaaaggggctgagaaggagaagccattggggaaagatgagaatcaagggtgtcgtgccccaggcgccaagtgcaggaactgttccgggaaggaataagtgcccagctgtgtcaaatgctgctgagatacccttccaaggtgcagaaaaaaatttgcacatgtggacccacacgcacctgtgagagagactg

SEQ ID NO: 333294 - DNA, 405 bp, Homo sapiens
aaggattcaggttatttatatataatatgaattttttaattgtataatataatcaattactataaaaaatttagattccattgaatgagcttcaatattatattctaactaggtagaaatttaaaatgtaggaatcatttaaaatacatttttggtacgaaaagcctttaagattaaaaataactgattaatgaccactacattttttcagtaaatcaataattagtctttttaacagttagaaactctcttttaattttttggggttgggggagggctggatctttcatcttcaaacatcacctctctcatccattcattaccatctatactcaatgccctctcttccacagattcaggtttgtgattaatcagtaaggaacttatggaaggagtgcttaatag

SEQ ID NO: 333295 - DNA, 374 bp, Homo sapiens
ctacttaagagaaaaccgatttttagttcatgaaaatttgagatgaatgggggttgggaggaaggcaggaagggtaatgtttactgaaagtgtatttctgaatgacagtggagacaaacaggtgctttccttcctaaccgggaatcccagcataatttagacatgaaaatgcccagaaggcctggcaattgagcctttaatttctacctgtaaattgcaatttatatgttggggatggctctattgagaaaccaaagactatgtaagaacatattgttttcggccctagactagggcactcaatttgttttggtcaaatgaattgcgggaataactaaatctcactgttgttccagcaaaggccttggattaag

SEQ ID NO: 333296 - DNA, 462 bp, Homo sapiens
gttgcggtgagcagaggtcacgccattgcactccagcctgggccacagagcgacactctgtctcaagaaaaaaaaaaaaaaagcctgatgaggatgtgagggtgatctggctgcaacatctgtcaccctattgatcaccagggttggttctgttaccgaccatagtttcttgcgttctccatgcaatagaaattgacatgaggccgaaagacttttcccagacaagacttcattggagcttttgcctggacataagggaggcagcacaagagagaattccctgactgactctgtgcaaagagccggtagggctttttaattaggcaaagcatgagaattgacatcaggggtggggtatgcaggctgggctgggcaaagcatgtgaggggtagggtatgcaggttagcactatttggttgtaatggttaccttgagtaatgggctacctggtggtctagctgg

SEQ ID NO: 333297 - DNA, 314 bp, Homo sapiens
ggtctctgtcacccaggctagactgcagtggcacaatcagagctcactgcagcctcagcctcctgggctcaagcgatcctccagccggactacaggtatgcaccaccatgcctggctaacttttcaaatttttttgtagagacagggtttcaaccatgttgcccaggctggtctcaaactcctgggctcatgggatcctcctgcttgagcctcccaaagtgctgggattataggtgtgagccaccgtgcccagccgaaagttggtgttttaaaatcatggaagaggtttatgagcaggggcaaaggtcagcgca

SEQ ID NO: 333298 - DNA, 255 bp, Homo sapiens
tttagtcagtgcggtgcttaaatcatatacatatgggcttatcttttccaagaaagatattcaacaagctacagtgaagctattattaaagttttcttttctgtttcagatgaagctgaaatattttagggcactttagcatttacattacaaatattcctcctgaggagtgggcacagaatgcacatttcacgaccacatggtctggggctggtttctaggctcctcacttaaccagtcacgtggtcttggcca

SEQ ID NO: 333299 - DNA, 626 bp, Homo sapiens
ctttcaacagctagtgatacttggcttcatataagattacccactaacaatttgatcttgaactctttcctcaaaggaagattttttaaagcatagagcaattatgtatgattccaattcaggacaaagtaggcggtaacttacatttttagctcttaagtgggtgctcacggccatatgtagctcctgagtgtggagattacatcccaaatatagaacaaggctcatctatacagtataattgtggaattctaagtctcagtctccaagccacagaaacgagggagctattcagagaagtggattccttcaagcaaatattctatactttcccccaatcaccatttttttcaataaatcaggttgcagctgagaagatgccaggctcatatattctcccttcaaatttatgtatttgatactttctattcggtttttttggaggtttcctcaacccagaaagggtggctgctgatcatctcttcctgaactattgttacacttgcccaagtacccaagcccttgcgtgtgacacacttgtgcacctggaatctcaattagttccaagcaatataaatagaaaaagtggccactggtaatggatataaaatgaagtggcagaaggg

SEQ ID NO: 333300 - DNA, 537 bp, Homo sapiens
ccctgttccctcaaaagctggcagcctggggaatgttgacagccagcacctttggcttgggctgtggccctctcactgtgagcattgtcagagatggcttcagtcagtctcctttactggctctggagcagccgtgtctactgagtggcagggtttggggactaggctaggctttaaagtctcactagcagggggctgcctggccccaataaccctggaattgacagaatgtccttctctgcctgcagccagccctctgtaaactgtatggccctggggccattttctttgcaggagggaaggtggaactaaggatcccgaatccgtttggaggcagagaggggccaacagggtgtttgaagggagcaaaggcatcgaaatttttggagcatctagaactggggcagtgaatgcagaagagtgggagcacacacacgtttctcctccttgacccagaatgggcacagccttcagagagctcttgccagctcctcactctagcctgggtgaagggggcatctgtgccaaagcaggaag

SEQ ID NO: 333301 - DNA, 126 bp, Homo sapiens
agagaaagtgagtccaaattaaggaaatgaaaaaaagacacaagatataggtggagaaatcttcagtgaaatatatagcataaaaaatataatgacatttgaattggttccaagtctttgctattg

SEQ ID NO: 333302 - DNA, 1218 bp, Homo sapiens
  misc_feature (62)..(62): n is a, c, g, or t
  misc_feature (1042)..(1042): n is a, c, g, or t
gagagattcagctgctttcacaactctggctggattttacctatgtggagagtgtcacccangttagggagcctctggccaggaggaagctgtggcaagatgtgctgcgtctcctgcttggcattgccatcttgctgccacagaacctccactcaatacaccagaaaacagagagtatcttgcagaaattatgttcgaatcatttaacgttccaggactctacattgcagttcaggcagtgctggccttggcggcatcttggacatctcgacaagtgggtgaacgtacattaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccagaagtggatcaaacagtacacgggtatcaatgcgatcaaccagaagaagtttgttatagacgttggttacgaaagattcctgggacctgaaatattctttcacccggagtttgccaacccagactctatggagtccatctcagatgttgttgatgaagtaatacagaactgccccatcgatgtgcggcgtccgctgtataagatggaacaaattccactgagctatcctcaaggtcacggattccatcctctgtcacctccatttcattgagatgatatattgagcccatgcgtagccttttatttgagatttccaaggccagcaatgttctcttcctctcccttttctttgtataaaaattcattctcaagaaaaactctcatatcaattgtttacatgtcactatggctaagacactaaaagccctctccctgcaaaactggtggcaaagctctctagagaaccacaaactgttgcatccttactacntggggcagcagcaagcccaggtgaagatgtgcatgttcttggagaaagtattaataacataccgacacttacatctgggtgaataatttcatcaaatctcttaactcacgcttgcacaaacttcacctggagagagagagggaaagctgtgccagaaataaatggttattgaggtc

SEQ ID NO: 333303 - DNA, 626 bp, Homo sapiens
  misc_feature (450)..(450): n is a, c, g, or t
tgggaggcagttgccacacacttctacatgaccagatctcttgtgaactcagagctcactcatcacccaagagatggcccacgccatccatgaggaatgcactcccatgatataaacacccccaccaggccccgcctccaagagtggagattacagttcaacacgagatttggtgggggcatatcaaaactacattaaccttaaattatgaagacggtaaactaaataatctgctttctttcctttcctgttttgtgtctgtttttcagatttccaaggccagcaatgttctcttcctctcccttttctttgtataaaaattcattctcaagaaaaactctcatatcaattgtttacatgtcactatggctaagacactaaaagccctctccctgcaaaactggtggcaaagctctctagagaaccacaaactgttgcatccttactacntggggcagcagcaagcccaggtgaagatgtgcatgttcttggagaaagtattaataacataccgacacttacatctgggtgaataatttcatcaaatctcttaactcacgcttgcacaaacttcacctggagagagagagggaaagctgtgccagaaataaatggttattgaggtc

SEQ ID NO: 333304 - DNA, 1064 bp, Homo sapiens
  misc_feature (62)..(62): n is a, c, g, or t
gagagattcagctgctttcacaactctggctggattttacctatgtggagagtgtcacccangttagggagcctctggccaggaggaagctgtggcaagatgtgctgcgtctcctgcttggcattgccatcttgctgccacagaacctccactcaatacaccagaaaacagagagtatcttgcagaaattatgttcgaatcatttaacgttccaggactctacattgcagttcaggcagtgctggccttggcggcatcttggacatctcgacaagtgggtgaacgtacattaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccagaagtggatcaaacagtacacgggtatcaatgcgatcaaccagaagaagtttgttatagacgttggttacgaaagattcctgggacctgaaatattctttcacccggagtttgccaacccagactctatggagtccatctcagatgttgttgatgaagtaatacagaactgccccatcgatgtgcggcgtccgctgtataagatggaacaaattccactgagctatcctcaaggtcacggattccatcctctgtcacctccatttcattgagatgatatattgagcccatgcgtagccttttatttgaggtattctcatgattttcatttttaattctaggctctacttttgctgaaattttctatttttttcatttgtttcaagagaacccataattgcttattgaagcatttttatgacaattattctaaaattctttgcaggtaatcccagcacctgagtcatctttatgttggagtctcaatcgactcttcattcatttgtgattttt

SEQ ID NO: 333305 - DNA, 1419 bp, Homo sapiens
actcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatgaaacgcctagtgcagggaatgcttcccgggaactttccagttctcctgccgcattggctttacacaaacacagacaaattccacctggcacctgtttttggctgggccaaggagctgcctctactgctcccacgtgttcctgttgaaaaacaaaggactttccactggtctgcagatcagatcagctgggtccagagtttaatgggcaactggacaaccaagttaaccccaattgaaagcacccctaggaccattgaacacccactgccggggaccactgtccagtgaatggattgaggccttttaaaggtcactcaggttccaggttgacagttggaggacttcaccgtaccaaccctgaagagattgtattacacattaaggaccttggtagctgtgcttcagcaaacgtcaaccatggtagcaaattggtgaggctgtgaccaataatgaggaaataatctggcaaatttttaggggtgggaacttttttaaatgttcatttagttcgttttcaactaaattgtgtttagggatctgtgtttgagatttttctttatttcttttttttttttaaatagtaagtcacaggtccacactgtgtaaacatgcatctgataagatactgctgatattctaaacaagttgaaataatcttgccttagtgatcatgattacacaaaagaggtgcactgccaataagtatctctaattcaatagttgaaagcaacctgcatgctaatcgtggtttcggggtgagaataaaacacccccacataacatgcatttgcatgggcccgaacctgtgaaatgttacgtttgtgcttcatttttgccaaggtaaaaatgttccatcatttctagctaaaactccatttggtgaaaccaacatatccatttcttttcctagttacggatgatttggggatgcttttgcagaaatgtgttcataga

SEQ ID NO: 333306 - DNA, 1477 bp, Homo sapiens
actcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatgaaacgcctagtgcagggaatgcttcccgggaactttccagttctcctgccgcattggctttacacaaacacagacaaattccacctggcacctgtttttggctgggccaaggagctgcctctactgctcccacgtgttcctgttgaaaaacaaaggactttccactggtctgcagatcagatcagctgggtccagagtttaatgggcaactggacaaccaagttaaccccaattgaaagcacccctaggaccattgaacacccactgccggggaccactgtccagtgaatggattgaggccttttaaaggtcactcaggttccaggttgacagttggaggacttcaccgtaccaaccctgaagagattgtattacacattaaggaccttggtagctgtgcttcagcaaacgtcaaccatggtagcaaattggtgaggctgtgaccaataatgaggaaataatctggcaaatttttaggggtgggaacttttttaaatgttcatttaaaaaaaaacaaaaacagggcagtcttgtagtttaaaatatatttctaaaagcttaacagttcgttttcaactaaattgtgtttagggatctgtgtttgagatttttctttatttcttttttttttttaaatagtaagtcacaggtccacactgtgtaaacatgcatctgataagatactgctgatattctaaacaagttgaaataatcttgccttagtgatcatgattacacaaaagaggtgcactgccaataagtatctctaattcaatagttgaaagcaacctgcatgctaatcgtggtttcggggtgagaataaaacacccccacataacatgcatttgcatgggcccgaacctgtgaaatgttacgtttgtgcttcatttttgccaaggtaaaaatgttccatcatttctagctaaaactccatttggtgaaaccaacatatccatttcttttcctagttacggatgatttggggatgcttttgcagaaatgtgttcataga

SEQ ID NO: 333307 - DNA, 1249 bp, Homo sapiens
tctagaaatgacaccattaatacaggcaagactgaagttatgtcaaagggaagattactatgtgtagaccaggaaaacaaagtagttgtgcaggctgtgatctctatcaaatattgaggactgtgtgtttgataaagctcaggttaaattcatcatataaattgacattatgtgcctgagtttggtcaataagattaaatacattttatgagaaagctttaaggtacttaattattttgttaatgcttacagtatttctaataccagatagtcttaagtatctatcatagatagatattcagccaaaatgaagtaggattatataaattagttgatgaaattctgtagttattaaggggaaaatcagagatggaaattaagttgcaattatttgggttagatccacatggcctctattaaaggtgatttacatgtaaaaataagtctaggcaacacagcatgacctggtctcaaaacaaataaacaacaaccataggcaggtatggtggcacacacctgtagtcccagctacttgggagcttgaggcgggaggattgattgagctcaggagttcaaggctggagtgagctatgatcacacaattgatctccagcctgggcagcacagtgagaccctgtctctgaaaatgaaaataaataaataaataaatctttttagagtactttgaaatttgtcgttttattgcataatataaagagattttgtacttttaatcagttcatggtgttataattgaaatgtcactgttacgcagtcataaggtaaacatttagcacttttcctttatatttacccaaaagtgaaaaccagttcttgtttacttctcaaaaaaatgaaaaagaatactttatttgtaatatctttgtagtctcattcacagaattcctaatcccccgcaacccggaggctgtaaaaatgaggataaggggttagaaatttccaagaagtgactgttgttaagatagacattgaaggacagcaaaataagagtagaattaggtatcataaagagcatagtctttgaatccaaggttcagtttaccccgaatctagatgttggatacttcaagagtagaaaattgttctatcacatcttaaaaaactgttgttttaatggtaactattgatttgacccactttaaatgggatatattatatttgcatatagaagatgaagctctagtagcttcaacgtaaaaaaaaaaaatctttgaaatgtatgctcact

SEQ ID NO: 333308 - DNA, 93 bp, Homo sapiens
ggctatgactttatctactaccatggttcttaatactgacatcacactcaactgggaactccagaacacatccattgctacaggtagaagact

SEQ ID NO: 333309 - DNA, 425 bp, Homo sapiens
gggtcccataatgtttgcggggaaggatactttgtcatcagaatagcatccctgtgtccctgttttatgcatcaagattaagtgaaatcattcatgcaaagtggtttgcacggtgccgaacacaaaagaacattcgaatgcacccggggatgatttttttccccaaggtgggactcacctacacaggaagacagagcttcacaaaagcgaagccccagacctcaaagtctctcatgtttctctaccaaaggacccaccaacaaacagttgctgtgaaagttgccccaagctaagcgagttccttggcggtgtgctttgtttcaaaacatgccatcccaaagatctccagactgcttaggtttttaaaccaacatttgtcattttgctgcacttgtctttactcaaaacctcaaagacctaaagtg

SEQ ID NO: 333310 - DNA, 377 bp, Homo sapiens
tctcccctttttctccccttttggtaccgttttcttttttgcatattttactgttgaatttaaatatatctttctacttcattgttagcttaccactcagataatttcccaacagaaaagggtgtttttgtcttcctttgtactttttactttctgcttttaacttgggtaacttttgcatatccactgtctatggcccccactttaagagttttgtaatatcgtttggtttggtgatttgtgtgtggtgttgatcttcctactttctgtgtcttaacacaccccttagatgccgtggggtcgtcgtctttttttgtggggtggactaggtggctcattccctaaaagttctccgaaacattgtgacctaatatcct

SEQ ID NO: 333311 - DNA, 513 bp, Homo sapiens
cccaccacagtgccccaccaaagtgtgcagacttacacacacatacatatgaactgaacacacagtgatggtaaactgggcccttagaggaattagaccaggcccttggcagaattctggcccatcaccttatgtctctggtctcagttacctcatctgtataataggagtaacgctgcttcacaaacgttattcagtgtcaccacgctgaaatggaatcaaaggtattattatcttgaaagagcatggaaaagagtagtcatgcaggtagtccaggaacacagcttaatctggaagggctatttctgtgatcctgggaggtgggcaggcatggcatgagaggcttggctgtcacttcctccccttctgtcctcttccctcttccctctttctcctccctctcttccttctacgttattaaacacctgtgtgtgccagaatataaagacaaatacatcactacatcagcagaagctctcaatcaggtggggaacgtggagatgcacgctgatg

SEQ ID NO: 333312 - DNA, 402 bp, Homo sapiens
aatagaacaccattcagcaatttcattgggattggaaccacctttttctgtttaaacagactgcctgatcttctgcttttccccttgcattttaaagctgcagtctctgtcacatgccgttgagaatgctactctgacttatccttggtctcaaatttcacacctgttagggtaatttgcatttttgacagaccgatgcctcagatagatatctgtatttagatcatgccctaatcaaattttagccaaaatgtgtgagagacaaatatttctactgttacaactttaaacttaagtataataattttctagttctttactaagactcattttcattagcatcatgtttctatcctcaaaattatagtaatagatgctaagcatagatactgattacaaagg

SEQ ID NO: 333313 - DNA, 388 bp, Homo sapiens
agttccaaagagcagtaagtaagcagtaagtgaattagcttagtccctaagcaggacagcaggacatctcacgttttactcagccctcccttaagaacttccctttggcaggtggaattgggatcaccctgagggtttaggattgacatgacaatgggaaatgatgagggctgaagggcaattgagtgccacaaagccaccttgaagccactgagcagtgtctgaggaactgatttcattctgcctctgcctctgaagattttgtgttattgattctaacaaagcacttctcaggtgactcccagactgctggagtagtttgaaagaatagaacccttgagtaaattgtaggccccaggcttcctgcaagaaccaagcgctgaaagaa

SEQ ID NO: 333314 - DNA, 453 bp, Homo sapiens
tcttacctataaaacagaaacacgtttttagcaaggaatgaaatagactgcatggcacaacctaagtggatcttccctctgacaaaagtcattgtactctggttcaggctactagatctagtgaaagcagcagttcaatttaattcaatagataatttatttagcacctactcttggcaaggaaaagttctacacactgcagagatgcagcgatgaactagttcagaatttactggctgtgtacctactgtcggcccacatttcagtgaagaaggtagagatgtgaaaagtctttctagtctaaggcctgactattctctgtcccaaatgcagaatgcagaagatgctaagaaggccaaaagtggctctgtccagctgggaggtcaggctgggctccattgaaggaggaagcatttcaattgcggagtgaggtctccgtatttgggaggcaag

SEQ ID NO: 333315 - DNA, 298 bp, Homo sapiens
aaagccatagtgctcactagcatatttagaaaaatcagaaactaaggttgtatcaagaaccctaccattataacaatatgaaaaaatccatccaaaagaagagtttttagtacttgttcaaatatttgtttaattaattgttgctctcaactgattttggcattctttcagaattggctagtttggttggacagtcagagtctaagttttcatgctcaattcaggagctgatctcagtaattttgatatacttttcttctttaggcagcacagatgaccttaataattatgtttgaag

SEQ ID NO: 333316 - DNA, 457 bp, Homo sapiens
ttttttttttctgagattggttggggtgggggtggggtggtctcactatgttgcccaggctggtcttgaactcctgggctcaagcaatcctcctgccttggcctcccaaaatgctagaattataggcatgagccactgcatccggcccatttggctttaaatatctttcacaaactgttctcatcttacttctccagctaggtcccacagagtcccctgtcctggcaggcaggtcaacgtcggcaacatgctccctcagtgccctggatgaagttgtctctacctcagtggcgctttctcttttctgtttctacatatccttcaggttcaagtcctgattccgacttcaggcctgtcccaacaacctacagtctgcacagacctttttcagatgcagaatgcaggagcaactgctgagctcctagtgttttgctgatgaaaggaccaggtgatttca

SEQ ID NO: 333317 - DNA, 179 bp, Homo sapiens
aggcattctgagtcgatagcagatccccattgtcctgtcatcctccaggtgaggttctgtgtcttacagattaagaacatgaccctaaatcagcagcagatgtttaaaataacacagaaacaaacctcgtatattctatattttccctagccgcttcagaatttgctatgaaatttaag

SEQ ID NO: 333318 - DNA, 645 bp, Homo sapiens
tcgcgacgtgttatccccccagggattccctgggggtaactgagaagtaggtccctaggaaggacttcagttctgtctgtggacaattgggacaaaagggttaagggaaaatcaatgttgttctttggctattaagacaaatcttggaaggttcctagaaacggaggattgttagctgataaattcattcgaacttagaatgaaggaaggaatgaaatggcctcatttgtaatgtactctttttggttagtttgattgttttttacatttataagcctgtttgggtactctgattacttgttagaagactcgtaaggttaaacaatccacattattacagattgtctgatttttacgaccagacaagaagattgaagctctaagtgcctgaaaacccttttctacagagtagttgtttacacttcccttctgagaaccatatgaaaacaaggaccttatttgtctgttcaccactgtacccctagtctagtactctgtgtgtgtgtgtgtgtattacatatttaagtgagggaactttcattcacatgactagaatcaaaacaaaaataacctgcttttatctaaaaggggcagtaaaaactagaggatacctaattatacttctgttcaaatatgaatttaatg

SEQ ID NO: 333319 - DNA, 324 bp, Homo sapiens
ctatctaggctttcccgtcccccatgaaaattgcctttctgacccagcaggccctcaaagcttctaagagtttcggtggaacactgatttctgacacgtgatgtcagcagggaaggggacagcaacagaggtggaggaggtggggagggacagtcactgtcactacagcattcagcagagtcaagggacatggagaatatgaggacactctacccagtactgggaacctaaagacacaaccaggtcaacatccatggttttagaggcagcttggtaacttttcctccacagtggacagagggctctcagggagaggcgtgaagg

SEQ ID NO: 333320 - DNA, 108 bp, Homo sapiens
taaacagttaacagaacaccacacagtaatcagaataaaagaggggccttctttgtaaagaatggtgctctgggccgggcccagtggctcacacctgtaatcccagca

SEQ ID NO: 333321 - DNA, 130 bp, Homo sapiens
ggcccacgccctggaaccttccggagcagctggcagaacccgggctgcggtgctgagactcagacgctggtttccggctcctaactcccgtgctgcttgttagctttctgttacgacgttggctgtgtcg

SEQ ID NO: 333322 - DNA, 359 bp, Homo sapiens
cggaagcacactgcaacagcctaaagatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttga

SEQ ID NO: 333323 - DNA, 474 bp, Homo sapiens
caagacaccgcattctctcaaaattctgggttaagataattgttttgatagacctttggagcatgtaaaacctatggttagcaggaaatttcaatctcctcaaactgattttaaaaccatacttcatttttttcctcttttagttctataaacatgtggtacagagtgttgagaagtttattcagaaagtaagtatataattttccatacatgtgctgtaattgtagattaatgcctgtactcttctcctttaaatcaaatacccaagtttaaattgttttgatggactgttaaaaagtgattccagttattttattttccaattaagaaataaaataaaagtgcctttcagataattttacttaggtttgtattctgcctatgttcatgtgcctaaatgtaagcagagccagtttgaggatcggtgtcatgtgtattaaggattcagagattgcgtgtttgcagtcctgttta

SEQ ID NO: 333324 - DNA, 542 bp, Homo sapiens
  misc_feature (498)..(498): n is a, c, g, or t
gtattggattaatactctcctagttggtcttcctttgttgtattttgtgataaaaaattgagtacggttagttcctcttacatcagccagccattgagatacatatctattgtatctcttctaagtgttttctttagatgaaatattttagtgtctttcctttgtgtctcatgtttcatggttttttgaactccatagtatcctaatcagattaatctgggcagaaatctagagtggcacctacggttgtggatatatcttaaagatgtgccaaggtagatgaaggatttagatgtgaaataaatgaatacaaagaagaaaatgaaaagttgcacctatccaaaggaaatcaatttcaactattttgtttagagtgggaaactgtgaaaagctcagaacctgttaaagagacggtccagacaactcagagcccaactccagttgaaaaggagacagtggtcacaacccaggcagaggttgcggtgagccaagattgtnccattgcactccagcctgggcaacaagagcgaaacttccgtttc

SEQ ID NO: 333325 - DNA, 294 bp, Homo sapiens
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggaggtgaaacaggagcccgtcggaggaaggggcagaagggagtggagagtgtaggggaaggggctagagggagggggaccgaaacggagcggggcagagaagagaaggcgccgcggcccagcccctcccccgcccgc

SEQ ID NO: 333326 - DNA, 4635 bp, Homo sapiens
ccctttggtggtgaaagattgaataggatatcaaaacaaggaatgaagaatgagagcaaaaattttgaagattaacttgtctatttcaaaatttaaatggaagagagaaagggaattacttcttgctcaatttctggtatcctgttttgggaggacagaattcaggcaaattctattatactatgcttgatcagtatcactgtttatgggtctatttttaaaggaaaatacattccaggaccttaacaacacgtatttattaatttttggaatttcactcactgataaggtttcataaccaaccaagacaaaactgatgtttatggtagggtaagcttgaataaagggatttaagaacaaagttcaaaacttctaacttttggtagatattcagaagctaagatgtgtgtgtgtgtgtgtgtgtgtgtgtgtgtgtgtgtgtgtgtgtgtgtgtttaatgtacctaattctgtaaaggattttaagtgattttttcaaagtggacacaataaaataaaaacaatatgcgtgcatgtgttttataaaagtaataaaacaagttattctgctttttctagtcttagttacttacttacatatttatttggggggtgtgatgttctttttaaaaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttga

SEQ ID NO: 333327 - DNA, 5228 bp, Homo sapiens
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggtaaaagtaaatgtttttctgggtcataaatttctaaaagtagctaaagaaatcataaaatattttatactagcagtgccctgaatatatttttcccacacttaagctccactttgtaattgtttcacctattaggccaagcttgtccaaggcctaagcatggcccctaggccaagcacatggcccagaactgctttgaatgcagcccaacacaaatttgtaaactttcttaaaacaatatgagatttgtttttgcgatttttttttttttttaagcttatcagctgtcattagtgttagtatattttacgtgtggccaaagacattacttcttctaatggggcccagggaagccaaaagattggacacccctgtattaggcattaatgctcccatcgtcaatatttttaaaaacagaattgtcaatgtataactctgtctcaaccagcctttctgtttgtttgctgttcttttgactttcaaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttga

SEQ ID NO: 333328 - DNA, 3058 bp, Homo sapiens
gtattggattaatactctcctagttggtcttcctttgttgtattttgtgataaaaaattgagtacggttagttcctcttacatcagccagccattgagatacatatctattgtatctcttctaagtgttttctttagatgaaatattttagtgtctttcctttgtgtctcatgtttcatggttttttgaactccatagtatcctaatcagattaatctgggcagaaatctagagtggcacctacggttgtggatatatcttaaagatgtgccaaggtagatgaaggatttagatgtgaaataaatgaatacaaagaagaaaatgaaaagttgcacctatccaaaggaaatcaatttcaactattttgtttagagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttga

SEQ ID NO: 333329 - DNA, 5111 bp, Homo sapiens
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttgataacagtgttctaggaattgtatttttttaacctataaattcttaaaaccttgaattattattagcatgtgcttattttttgcaaaagctttctatcataacaacaatgaactatgtggtggaaaaagcatgtactttgatataaaaatcatgcagcctcctcagtatgtgtataatatctgtgtatgtttattgtggaagtcgtgtagtttttttctgtttctctgtatgtccgtcttcatgcacatacagagaaaatagaaaggtgagaaagtttagataataaaatattcttttaaatctggtagaatattggagaaatctggctaattaacatgggttatagttaaagctcttggtcttgatg

SEQ ID NO: 333330 - DNA, 4501 bp, Homo sapiens
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttga

SEQ ID NO: 333331 - DNA, 4690 bp, Homo sapiens
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtcctcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttga

SEQ ID NO: 333332 - DNA, 3478 bp, Homo sapiens
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagatttccataaattgaagcaaagccgattctttgatgaaaatgaatcccctgttgatccgcagcatggctctaaactggcgcgattataatggggatgatggtaacgtaggtgagtatgaggccggcagcggctgagctggcttacatgaggacagaagatggtcgtgtg

SEQ ID NO: 333333 - DNA, 2854 bp, Homo sapiens
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtaaggaatttttgttttaatatttgaactctatttagattatcatttaagttgtgtttcttccagatttaagtaccatagagcagtggttctgagaccttagcatgcatagccttgttaaagcgcagattgctgggcccagcctccactgtttttgctttactcagtctgtggtaggggccagagaattttattttctaacttgttctcaggatgcagattggtgggagcaagatgcgcatcttgctcccatcagagtcgtgtaaggcaactgtcctggaggttgtatgctgcatgccactgactcactgatgtcctcatggtccattcctgagaattccagtggtgagaactggctctcagatgaacttgtctggtcacaggaaatccctactgaaaaagacctgcttctttgtggtgaaggagctatgatttcaatatgttctttggtagcgaaaggatccattctgcgtatttaactgatggtgcatccatgggcaggagagctgagtggcag

SEQ ID NO: 333334 - DNA, 726 bp, Homo sapiens
cggaagcacactgcaacagcctaaagatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttgataacagtgttctaggaattgtatttttttaacctataaattcttaaaaccttgaattattattagcatgtgcttattttttgcaaaagctttctatcataacaacaatgaactatgtggtggaaaaagcatgtactttgatataaaaatcatgcagcctcctcagtatgtgtataatatctgtgtatgtttattgtggaagtcgtgtagtttttttctgtttctctgtatgtccgtcttcatgcacatacagagaaaatagaaaggtgagaaagtttagataataaaatattcttttaaatctggtagaatattggagaaatctggctaattaacatgggttatagttaaagctcttggtcttgatg

SEQ ID NO: 333335 - DNA, 260 bp, Homo sapiens
tttgactttcaaggatatggatatagatgaagggcaagatggagtggaagaggaggtctttgaacaagaagctaagaaagtggcggttcgctcaagatcaagaacacattcacgatctcgttcaaggttctacaatgatatttaataatagccgtgtgtgaactttaaaatgttggctttatttctttgcatcaggatgaaaggaaatgtttccttgggatgacatattttttctcagtctctcggaaaaaaagttattc

SEQ ID NO: 333336 - DNA, 4663 bp, Homo sapiens
gccgctgagggagcccttccccgccagcgcgtgcccttccactccgccccgaggtcgcagcggcccgctctcccgccagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttga

SEQ ID NO: 333337 - DNA, 4744 bp, Homo sapiens
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttga

SEQ ID NO: 333338 - DNA, 4154 bp, Homo sapiens
gcatgggagggaggaagagaggtttggggtgcggtggcaggtgatatagggaaagttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggtaaaagtaaatgtttttctgggtcataaatttctaaaagtagctaaagaaatcataaaatattttatactagcagtgccctgaatatatttttcccacacttaagctccactttgtaattgtttcacctattaggccaagcttgtccaaggcctaagcatggcccctaggccaagcacatggcccagaactgctttgaatgcagcccaacacaaatttgtaaactttcttaaaacaatatgagatttgtttttgcgatttttttttttttttaagcttatcagctgtcattagtgttagtatattttacgtgtggccaaagacattacttcttctaatggggcccagggaagccaaaagattggacacccctgtattaggcattaatgctcccatcgtcaatatttttaaaaacagaattgtcaatgtataactctgtctcaaccagcctttctgtttgtttgctgttcttttgactttcaaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttga

SEQ ID NO: 333339 - DNA, 4901 bp, Homo sapiens
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttgaaaaaaaaaaaaaaaaaaaacttttgtgggcggcccggcccgaaaaatttttaaaccatccttgggcgcggcgccaggtaatggacacggtcctccggtcccagggacccgcccgcacagggtggtttcaccaaaaaaccggggccgctctcgcaacc

SEQ ID NO: 333340 - DNA, 5242 bp, Homo sapiens
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggcaagatgatgatgaatgaagtcctggcagcttcctgtgtcccaggccttgtagaaataaatgagacagacgtgcttcaaagttctaatgtgcatcacatcggatcttgtttaaggaagcgttaaaaggaacccgccgttacctattgagaaggctctgtactctcaggcattgtttctgattgaatccagaggttgcaagcatgccttcctgtattacctgttggagcaggtttaattttataaattttaaacacaaactctatgagtttctagttcataattgttctttttggggatccactcagatgaacagtattgcatctgtaagagatacccacttcccaggaccagatttgattggaatatcagtggcaacagactccatctgtagctcatccagtaccagtgatggaaaggacagatggcaaggaaaccctttcggggggaaaaagaaagtcatattgtgttggacctacagattactagaaacatagctttagtaaaccaaggctttttttcttgaacacaatctgtgtagactgtgtagttcttgattggtggctttaatccattatcattaggtatctccttgaacgttctcaaacactgaaagtcttaagctttcattaaaaaaaaaagagtaaatgcagctttcagaaaatccaggattctgtacagtcttcgagtgtttcacttcagcctccctgtcctgttattaccaacagcaggtacccgggtggtagacaagaagcctcatgggatagataaggaaatgaagataaacaaacatatcacactgtatcgtaaacatactttataagtacatttcttattagcttcttatccaggtagagattataaaaatttgctgcaagtatccagaccagaatttatgttttggaaattatcagtgttcacaatacctgcagggaagaaaaaaatacaaaaactcaaatatgaatactctttacacccaaaagaatatttttatcattcttttatttgtttttggctctgtcaaaaattaaagtgcttggaatgctgtagtctgtggtctcttgaaatttaatcaatgagaacttagcattttcacagtatgctgtcactttggacattcataataaaaattgaaactaaaaaaaaa

SEQ ID NO: 333341 - DNA, 1760 bp, Homo sapiens
gaggatcctgcgctttaactgcggttacaatggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactatggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttga

SEQ ID NO: 333342 - DNA, 3521 bp, Homo sapiens
  misc_feature (3319)..(3319): n is a, c, g, or t
ggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcaggtaaataataataataaaatttaaaaaaagaggttgcctctctgtatttggtgtttaattctggggtggcatgcgtttgtaaccacttcaatctacagatgctgaaatgtcgcactttttttttaaaagagatcactatgtcctaaaatttctatttgaaaaagtggccttctgttcaggataatctagatttcaatatgtttccattaagaccctcacaccaccacccccttttttttgtcctattgggactacttcagtgtgttgtcaaaataatactgcacaaaatctgtatacttataggaagataaaaatgaacaagtattgggtgtgagtaacttctatcgggaacttacttctaataggtattatccagctagctctagaagataaatatggtgtttgaaagcagtaagtcctttttctatggtcccactgttggtacattaagaattatggtttagaggcacttgaccttgatgcctgtttgggtctcttctaagcatacttttctttcctttctttcctgtcctaaagccttttaaacctccactcctgttcttaaaaaaaaaaaaaaaaaaaaaaaaaggggggggggaaaaaatatccccgggggggggcccaagtttagggcgtacccgggttttttgtacaggtgggccccaaataggagcggaattaaaaacgaaggaangggcggggtgtaccagggcgggctggggacacctggtcggttgggtctttgggaggacctacttctgggggggcaaattttggccaaaccacgaataaagccgaggattttacttccggtaagcgccacggattggggtgaattggtggtttatagtattataataatattatctaataaatattttacaaataactattca

SEQ ID NO: 333343 - DNA, 379 bp, Homo sapiens
  misc_feature (4)..(4): n is a, c, g, or t
  misc_feature (12)..(12): n is a, c, g, or t
  misc_feature (73)..(73): n is a, c, g, or t
  misc_feature (90)..(90): n is a, c, g, or t
  misc_feature (96)..(96): n is a, c, g, or t
tcgncatactgntccgtagtgtcagatggccgccgtatcctacgagccccatggaagacgttggaaatagcanggatccaccctttgacnccttcngaacattcggcacgaggctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtc

SEQ ID NO: 333344 - DNA, 747 bp, Homo sapiens
ccactgtgggctcagcacccacacaactgcacaagcccacctttcctgttccttctcaggtggctcacccagaaaggcgcccggcagaagaaaatcaacgagtggctggggattaaaaatgagactgaggaccagtacgcactcatggaggacgagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagatgtatgtgtttatgtgtgtttaaataatatgttagatacacgtgtatacatacacccatatacaacagatccaagactggctgaccttcctttgaaatggttgaatctgctgtgtata

SEQ ID NO: 333345 - DNA, 4417 bp, Homo sapiens
tgggcactgagcacattcggttatttccagaaacgctccgcggtcttggggatcagcctcagttgtgccagtgcggccgtagagagtgttcggccatttccgaaagcgctcgggcgtctctaagcccagccgagcccagtctcggatccctcgccgacccgattgcactcggctacctctggaaacgctcggctgtctcgggggcaccctctagtccaccagtcccgcgggattacgttcggctacttccggaaacactcgggtgcccccttacctcaggctccgcctcggcctcggttcatccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggcccgccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagcggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcccacggccctccctctgatgcagattcagggcttctcttcgatcatgtgggtttgattctgtttttccttgactgaaaaccctctttcctctcctcttttgggacaagagccctggttttctacgctgccttggcaccacactgctgccccacgagctgga

SEQ ID NO: 333346 - DNA, 4101 bp, Homo sapiens
tgggcactgagcacattcggttatttccagaaacgctccgcggtcttggggatcagcctcagttgtgccagtgcggccgtagagagtgttcggccatttccgaaagcgctcgggcgtctctaagcccagccgagcccagtctcggatccctcgccgacccgattgcactcggctacctctggaaacgctcggctgtctcgggggcaccctctagtccaccagtcccgcgggattacgttcggctacttccggaaacactcgggtgcccccttacctcaggctccgcctcggcctcggttcatccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgcgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagcggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtc

SEQ ID NO: 333347 - DNA, 2156 bp, Homo sapiens
attccgccacgtatctagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagcggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtc

SEQ ID NO: 333348 - DNA, 3326 bp, Homo sapiens
tgggcactgagcacattcggttatttccagaaacgctccgcggtcttggggatcagcctcagttgtgccagtgcggccgtagagagtgttcggccatttccgaaagcgctcgggcgtctctaagcccagccgagcccagtctcggatccctcgccgacccgattgcactcggctacctctggaaacgctcggctgtctcgggggcaccctctagtccaccagtcccgcgggattacgttcggctacttccggaaacactcgggtgcccccttacctcaggctccgcctcggcctcggttcatccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggcccgccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagcggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccaagagagcgcctgggccgttggcgagtgcgggcgggagcagacaaacagcactcagggtccaatctccggctgctgttgggtttcacctttttttctctcccatttcaatccttgtcttttggtttggccgtctctcagtggggtaacccccattgtccggagccctgttggccactcgccggcggacttggtatagggggcccaatgggatcacacacgg

SEQ ID NO: 333349 - DNA, 2857 bp, Homo sapiens
tgggcactgagcacattcggttatttccagaaacgctccgcggtcttggggatcagcctcagttgtgccagtgcggccgtagagagtgttcggccatttccgaaagcgctcgggcgtctctaagcccagccgagcccagtctcggatccctcgccgacccgattgcactcggctacctctggaaacgctcggctgtctcgggggcaccctctagtccaccagtcccgcgggattacgttcggctacttccggaaacactcgggtgcccccttacctcaggctccgcctcggcctcggttcatccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggcccgccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggagtgagtgaccgtctggagggaggcagggagggcttcccagaggagggggccatttggggtgggtttcgaagaatgagtaggagttcaccagggaggaaaagttgtccaggcagctggggagcctcggaggctggcaggtgagtgacc

SEQ ID NO: 333350 - DNA, 2222 bp, Homo sapiens
tgggcactgagcacattcggttatttccagaaacgctccgcggtcttggggatcagcctcagttgtgccagtgcggccgtagagagtgttcggccatttccgaaagcgctcgggcgtctctaagcccagccgagcccagtctcggatccctcgccgacccgattgcactcggctacctctggaaacgctcggctgtctcgggggcaccctctagtccaccagtcccgcgggattacgttcggctacttccggaaacactcgggtgcccccttacctcaggctccgcctcggcctcggttcatccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggcccgccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggtgggggcctgtccctgcaaggataaccgggggtcacaggtcacagagaccgggagttcagaggggatagaacatgtgcggtttcaagaatggagggccaggcacggtggcttacacctgtaatcccagcactttgggaggctgaggctggcagaacacctgaggtcaggagtttaaaaccagcctggccaacatggtgaaaccccgtctc

SEQ ID NO: 333351 - DNA, 253 bp, Homo sapiens
gtgagtcctgactggccctcgtggcgggggcggctgggagtgtgcttaaatgcggggcgcccgggggcagtgccgggccccggtggaagccagaacgcaagcgccaggctgcgtcgggccccgcgggaactgggggggccgcaggcaagggggggcctcgggctcggctccgcagcggtgcagcctccttgggacggtcggggcagaatggggagagactccccgcgtccaagataccggactggagccgagg

SEQ ID NO: 333352 - DNA, 4327 bp, Homo sapiens
tgggcactgagcacattcggttatttccagaaacgctccgcggtcttggggatcagcctcagttgtgccagtgcggccgtagagagtgttcggccatttccgaaagcgctcgggcgtctctaagcccagccgagcccagtctcggatccctcgccgacccgattgcactcggctacctctggaaacgctcggctgtctcgggggcaccctctagtccaccagtcccgcgggattacgttcggctacttccggaaacactcgggtgcccccttacctcaggctccgcctcggcctcggttcatccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggcccgccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagcggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtc

SEQ ID NO: 333353 - DNA, 3062 bp, Homo sapiens
cgaggtcggggcagcatttgagagctgactcgcctgtccccttcacccccagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggcccgccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagcggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtc

SEQ ID NO: 333354 - DNA, 3039 bp, Homo sapiens
tggggtggggcgggcggggcatggccagagtgagcggcgtctagaccctaagaagggaggggatggggtccagagtgagaagctgcgttcttgtgatgacggagcggagacctgggctcctgagtcgtgggacagaaggtgaaggggcctagtcccgaagcatgtgggtggtgcctgcaccttcccttctgctcgtcgcagctccggtactggtctctcgctcgcctttgtgtgagaatctatggagcacttactgcatacagctatgagggagctggcctcgcacatgtgcctgtatcatctcctcctccgccctgcacatactgtctcgtatatacccccaggcgtgcaagcgcacgcacaatcctgtgcacatgcgtgggcggacaggccctacccagccctcaccacactccccttccccctaaggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagcggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtc

SEQ ID NO: 333355 - DNA, 3119 bp, Homo sapiens
tgggcactgagcacattcggttatttccagaaacgctccgcggtcttggggatcagcctcagttgtgccagtgcggccgtagagagtgttcggccatttccgaaagcgctcgggcgtctctaagcccagccgagcccagtctcggatccctcgccgacccgattgcactcggctacctctggaaacgctcggctgtctcgggggcaccctctagtccaccagtcccgcgggattacgttcggctacttccggaaacactcgggtgcccccttacctcaggctccgcctcggcctcggttcatccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggcccgccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagcggcaagcgggatggcaccttcctcatccgcgagagcagccagcggggctgctacgcctgctccgtggtcaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtc

SEQ ID NO: 333356 - DNA, 948 bp, Homo sapiens
attccgccacgtatctagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagcggcaagcgggatggcaccttcctcatccgcgagagcagccagcggggctgctacgcctgctccgtggtcaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtc

SEQ ID NO: 333357 - DNA, 825 bp, Homo sapiens
ggggacggagtctcgttctgtcaccaggctggagtgcagtggcgcgacctcgactcactgcaacctccacctcccaggttcaagcgattctcctgcctcagcctcccgagtagctgggactacaggtgcccgccaccatgcccggctctggtctagtttttttcttctttgaatcccgtagggcctcagtgctgtgcagcaagcacatagttaaaactgaagaaaaatttcttgaataaaagtagttaacgtttttattctttacttcaaggtatatctccatgaataacctaaatgatcccccaaattggaatatccggcctaattccagggcggatggtggtgatggaagcaggtggaattatgccctgttggttccaatgctgggattggctgcttttcgtaagtcatggttttcttaaaattagtgttttccaggctgagagtgtggagccccggtgagggaggcagcatggtgtgggagcctgaaggccgtgactttgggacctgccagggacagccgagttttatcccctgcagtgaaccgtgggcaaatcacttaagctctgagcctcagtcttcctgttcacaggagatggataatcatacttaacctcagcacactgcaaggattaagtcagccaaggcgtttagaagcattttgtgtggggtgggttttaataacttagttccctctgaaggctttgctgctctcaagtcggggaggaggttccttatttcaggtgccctcataaggactgctggggaacaaaacgggtgtaaaggaaaccagtgggctgggcgtggtggctcatacctgtaacc

SEQ ID NO: 333358 - DNA, 431 bp, Homo sapiens
  misc_feature (408)..(409): n is a, c, g, or t
gcctactactactaaattaacggccgcgtcgacagaggaagccatactagaaaagtaagacaagagtgaaatcaaactgcttttagtgactcgaggccaggcagtcatgcgccttctgggtctccggcgtcttccgttcccgtgctgcccgtgtcatggccacaccgtcacccttcagcagcgacctccactcccgccaccgtctgagcagaagtgcaccgaagcctcagagacagagggtctcctcccgatgctctgccgctgttggggatatggtttcttgaagcatttttaggctgccagtattgtattaagcagaacagtataacctcgtattttagctccagggtaaaaatggttttttaaaaagtcaaatacaatactggtccttaccacaaaaaaaaagtnnacgcggccgcgaattaatagta

SEQ ID NO: 333359 - DNA, 1727 bp, Homo sapiens
  misc_feature (2)..(2): n is a, c, g, or t
  misc_feature (4)..(4): n is a, c, g, or t
  misc_feature (8)..(9): n is a, c, g, or t
cncncggnncgggtactgagtgggggcgccgcgcctgcgcaaagcggacccgcggacggtggcgttaagggaacgctgaggtcccgcgctccccgaccgaggtatatctccatgaataacctaaatgatcccccaaattggaatatccggcctaattccagggcggatggtggtgatggaagcaggtggaattatgccctgttggttccaatgctgggattggctgcttttcgttggatttggtctagggagtcccagaaagaagtagaaaaagagagagaagcctaccgtcggagaactgctgcttttcaacaggatctggaagccaagtaccacgccatgatctcagaaaatcggcgtgctgtcgctcagttgtccttggaactcgaaaaggaacaaaacagaactgctagttaccgagaagcccttatctctcagggacgcaagttggtagaagaaaagaagcttctggaacaggaacgggcccaggtgatgcaagaaaaaagacaggtgcagcctttgagaagtgcgtatttgagctgcctgcaaagggaagaaaactggcaaaggagagccaggcttttgctgaaagaatttgaagctgttctcacagaaagacagaatatctactgcagtctgtttcttcctcgcagcaagcggctggagatagagaagagcttactggtgcgagcgtccgtcgaccccgtcgccgctgacctagagatggcagccggtctcaccgacatatttcagcatgatacatactgtggtgatgtctggaacaccaacaaacgccagaatggcagactcatgtggctctatctcaaatactgggaactcgttgtcgaactgaagaagtttaagagagtagaggaagccatactagaaaagtaagacaagagtgaaatcaaactgcttttagtgactcgaggccaggcagtcatgcgccttctgggtctccggcgtcttccgttcccgtgctgcccgtgtcatggccacaccgtcacccttcagcagcgacctccactcccgccaccgtctgagcagaagtgcaccgaagcctcagagacagagggtctcctcccgatgctctgccgctgttggggatatggtttcttgaagcatttttaggctgccagtattgtattaagcagaacagtataacctcgtattttagctccagggtaaaaatggttttttaaaaagtcaaatacaatactggtccttaccacaaaaaaaagaaaaaaaaaaaaaaaaaaaaaaaaaaaaaagaaaaaaaaaagaagagaagaaaagaaaaagaaaagaaaccaaaaagagggggggggcgccgaaataagatatttcaccccgcgggggaacacccataagaagagcacacccacacatcgttgtagagcagaaagggcccaccaccatagagtggcaggatctaatgaacaggaaccaagcggcggcgcggcgcggtgaataaaaatacagagtatggcagggtgaagaaaaagatgccaactagatgggagagtagtacttcgtgaggggaagaacaccccattcctgcggggggggggggcaataaatatagggcacacaccccaccagagaaagtagtaagacgcgccgcgagcataaaaaaaaaaatgcgtgtgtagtcgtagtggaaaaacgacggactatttggctgggggacgaagaagtggctgcgagaatttgattgaaaatcttgc

SEQ ID NO: 333360 - DNA, 601 bp, Homo sapiens
gcctactactactaaattaacggccgcgtcgacagaggaagccatactagaaaagtaagacaagagtgaaatcaaactgcttttagtgactcgaggccaggcagtcatgcgccttctgggtctccggcgtcttccgttcccgtgctgcccgtgtcatggccacaccgtcacccttcagcagcgacctccactcccgccaccgtctgagcagaagtgcaccgaagcctcagagacagagggtctcctcccgatgctctgccgctgttggggatatggtttcttgaagcatttttaggctgccagtattgtattaagcagaacagtataacctcgtattttagctccagggtaaaaatggttttttaaaaagtcaaatacaatactggtccttaccacaagtaattttctgtctgtttcatcactccctaaatactttctcctcaaattatttttctctgtcaccagattacattaagaatttgtcagataatgtgtagaactgcataacaggtaatagaaagtagtaatattatattatcaagggtttatattttaaagatctctctcactccataaaggggaaataccaagtgtttcttgt

SEQ ID NO: 333361 - DNA, 1437 bp, Homo sapiens
  misc_feature (2)..(2): n is a, c, g, or t
  misc_feature (4)..(4): n is a, c, g, or t
  misc_feature (8)..(9): n is a, c, g, or t
cncncggnncgggtactgagtgggggcgccgcgcctgcgcaaagcggacccgcggacggtggcgttaagggaacgctgaggtcccgcgctccccgaccgaggtatatctccatgaataacctaaatgatcccccaaattggaatatccggcctaattccagggcggatggtggtgatggaagcaggtggaattatgccctgttggttccaatgctgggattggctgcttttcgttggatttggtctagggagtcccagaaagaagtagaaaaagagagagaagcctaccgtcggagaactgctgcttttcaacaggatctggaagccaagtaccacgccatgatctcagaaaatcggcgtgctgtcgctcagttgtccttggaactcgaaaaggaacaaaacagaactgctagttaccgagaagcccttatctctcagggacgcaagttggtagaagaaaagaagcttctggaacaggaacgggcccaggtgatgcaagaaaaaagacaggtgcagcctttgagaagtgcgtatttgagctgcctgcaaagggaagaaaactggcaaaggagagccaggcttttgctgaaagaatttgaagctgttctcacagaaagacagaatatctactgcagtctgtttcttcctcgcagcaagcggctggagatagagaagagcttactggtgcgagcgtccgtcgaccccgtcgccgctgacctagagatggcagccggtctcaccgacatatttcagcatgatacatactgtggtgatgtctggaacaccaacaaacgccagaatggcagactcatgtggctctatctcaaatactgggaactcgttgtcgaactgaagaagtttaagagagtagaggaagccatactagaaaagtaagacaagagtgaaatcaaactgcttttagtgactcgaggccaggcagtcatgcgccttctgggtctccggcgtcttccgttcccgtgctgcccgtgtcatggccacaccgtcacccttcagcagcgacctccactcccgccaccgtctgagcagaagtgcaccgaagcctcagagacagagggtctcctcccgatgctctgccgctgttggggatatggtttcttgaagcatttttaggctgccagtattgtattaagcagaacagtataacctcgtattttagctccagggtaaaaatggttttttaaaaagtcaaatacaatactggtccttaccacaagtaattttctgtctgtttcatcactccctaaatactttctcctcaaattatttttctctgtcaccagattacattaagaatttgtcagataatgtgtagaactgcataacaggtaatagaaagtagtaatattatattatcaagggtttatattttaaagatctctctcactccataaaggggaaataccaagtgtttcttgt

SEQ ID NO: 333362 - DNA, 531 bp, Homo sapiens
aatggggttggaatttggacttaatgggtaagaattgaaaatgggctattgtgtcttagaaacttcagtttgctgtagttcacgttactgagctcaaacattttctaagccaacaaactggtaactttacaagtttccttcctaaccgtgctcaccacattcatgctgtgttgaactgccatgcaaattcaataaggtttgattttctttctttgctatttcttacttgctttctatgttactttcttctcttttctgagaattattttctgaaccaaaaagtaaatgtttagcatcaggatcaattgtcaaataacaaacaaatattcaagttctaggataaaatgacatcttgtgagcaacccttaaattcccattaaaattttcactaggatgggggtggtggtggaacaactcataacattaaatgccaagacataaaatcaatctattcccagaatattgggagcaattagtaataattggtaaagtgaaaaaataagaaaattaatttggatgggactcagtgca

SEQ ID NO: 333363 - DNA, 1257 bp, Homo sapiens
gcgaaaagcgtttccgcagacagaagtggggagaagcggaggaattaaaaaaaaaaaaaagccttatttattatcattttccccaccgttggcatggcaacacaggcgtatactgagctacaggcagccccgccaccatcccagccgccacaggccccgccacaagcccagccccagccgccaccgccaccacccccagcggcaccccagcccccgcagccacccaccgctgctgccacccctcagccccaatatgtcaccgagctgcagagcccccagccccaggcacagccaccgggtggccagaagcagtacgtgacggagctcccggctgtacccgcaccctcgcagccaaccggtgcacccaccccttcgcctgcaccccagcagtacatcgtggtcactgtctctgaaggtgccatgcgggccagcgagacagtgtcggaggccagccccggctccaccgccagccagaccggcgttcctactcaggtggttcagcaggtgcagggcacccagcagcggctgctggtccagacgagcgtgcaggccaagccaggccacgtgtcgcccctccagctgaccaacatccaagtgccccagcaggctcttcccacgcagcgtctggtggtgcagagcgcagccccaggcagcaaaggtggccaggtctccctgacggtccatggtacccagcaggtgcactcgcccccagagcagtcgccggtgcaggccaacagctcttccagcaagacagccggggcccccacgggcacagtgccacagcagctgcaggtccacggcgtccagcagagtgtccccgtcacccaagagagatctgtggtccaggccactccacaagcgcccaaacccggcccggtgcagccgctgaccgtgcagggcctccagccagtccacgtggctcaagaggtgtgtgtctccccctcctaccccacgggcaaaggggctggtcccgggctggggctggggagtgcaggcccctgaggccgcagggagggaaatgcctctgtgagctgcagacactgccctacatccttcccctttcccggccccctggcagctcagggtccaggttttgctaagagagatctggattcaaacccctcttctttcttgcgtggccctgggtcagttctaacccctctccgagaccccgggcggcggggatcttccctcgggtggctgcgtgcgcgctcagcaacccggtgggtggaggcctggagccccgcccgcggccgc

SEQ ID NO: 333364 - DNA, 689 bp, Homo sapiens
ccctattagtctgctccagccgctgcccacgcggtcctcgcagcggcacacccacgaggcctgctcctgcacgttggcgaagtccacgcggttgaggtcgctcagcatctggttgatctgtgcggtgtgctgcagcagcagaactcgctggagcagtgggcggcctggctggacggcgtggtgagccaggtgctcaagccctaccagggcagcgccggcttccccaaggccgccaagctcttcctcctcaagtggtccttctacagctccatggtgatccgggacctgaccctgcgcagcgccgccagcttcggttccttccacctcatccggctgctctacgacgagtacatgtactacctgatcgagcaccgcgtagcccaggccaagggcgagacccccatcgccgtcatgggcgagttcgccaatctggccacctccctgaaccccctggaccccgacaaagacgaggaggaagaagaggaggaggagagcgaggacgagctgccgcaggacatctcactggcggctggcggcgagtcacccgcgctgggcccggagaccctggagccgccggccaagctggcgcggactgacgcgcgcggcctcttcgtgcaggcgctgccctccagctaagcccttggcctccccgccccacccgcccccgccacccctccacgccagggtcc

SEQ ID NO: 333365 - DNA, 3086 bp, Homo sapiens
gcgaaaagcgtttccgcagacagaagtggggagaagcggaggaattaaaaaaaaaaaaaagccttatttattatcattttccccaccgttggcatggcaacacaggcgtatactgagctacaggcagccccgccaccatcccagccgccacaggccccgccacaagcccagccccagccgccaccgccaccacccccagcggcaccccagcccccgcagccacccaccgctgctgccacccctcagccccaatatgtcaccgagctgcagagcccccagccccaggcacagccaccgggtggccagaagcagtacgtgacggagctcccggctgtacccgcaccctcgcagccaaccggtgcacccaccccttcgcctgcaccccagcagtacatcgtggtcactgtctctgaaggtgccatgcgggccagcgagacagtgtcggaggccagccccggctccaccgccagccagaccggcgttcctactcaggtggttcagcaggtgcagggcacccagcagcggctgctggtccagacgagcgtgcaggccaagccaggccacgtgtcgcccctccagctgaccaacatccaagtgccccagcaggctcttcccacgcagcgtctggtggtgcagagcgcagccccaggcagcaaaggtggccaggtctccctgacggtccatggtacccagcaggtgcactcgcccccagagcagtcgccggtgcaggccaacagctcttccagcaagacagccggggcccccacgggcacagtgccacagcagctgcaggtccacggcgtccagcagagtgtccccgtcacccaagagagatctgtggtccaggccactccacaagcgcccaaacccggcccggtgcagccgctgaccgtgcagggcctccagccagtccacgtggctcaagaggtgcagcagctccagcaggtgcccgtcccacacgtgtactccagccaggtgcagtatgtggagggcggcgatgccagctacacggccagtgccatccgttccagcacctactcctatcccgagacgccgctgtacacgcagacggcaagcaccagctactacgaggccgcaggcacggccacccaggtcagcacccccgccacctcccaggcggtggccagcagtggctccatgcccatgtacgtgtccggcagccaggtcgtcgccagctccgccagcactggggctggggccagcaacagcagcggaggtggtggcagtggtggtggcggcggcggcgggggaggcggtggcgggggtggcagtggcagcaccggaggcggcggcagcggagcaggcacctacgtgatccaaggcggctacatgctgggcagtgccagccagtcttactctcacaccacccgtgcctcgccagccacggtccagtggctcctggacaactatgagacggctgagggcgtgagtctgccacggagcaccctctactgccactacttactgcactgccaggagcagaagctggagcccgtcaacgccgcctccttcggcaagctcatccgctccgtcttcatgggcctgcgaacccgccgtctgggcaccaggggcaactccaagtaccactactatggcctgcgcatcaaggccagctcacccctgctgcggctgatggaggaccagcagcacatggccatgcggggccagcccttctcgcagaagcagaggctcaagcccatccagaagatggaaggcatgaccaacggcgtggcggtggggcagcagccgagcacggggctgtcggacatcagcgcccaggtgcagcagtaccagcaatttttggatgcctctcggagcctccctgacttcacagagctcgacctccagggcaaggtgctgcctgagggcgtcgggcccggggacatcaaagccttccaggtcctgtaccgggaacactgtgaggccattgtcgacgtcatggtgaacctgcagttcaccctggtggagacgctgtggaagaccttctggaggtacaacctcagccagcccagtgaggcgccaccgctggctgtacatgacgaggccgagaagcgactgcccaaagccatcctggtgctcctctccaagttcgagcccgtgctccaatggaccaagcactgtgacaacgtgctgtaccagggcctggtggaaatcctcattcccgacgtgctgcggcccatccccagtgccttgacccaagcgatccggaactttgccaagagcctggagagctggctcacccacgccatggtcaacatccccgaggagatgctgcgggtgaaggtggccgcggctggcgccttcgcgcagacactgcggcgctacacgtcgctcaaccacctggcgcaggcggcgcgcgctgtgctgcagaacaccgcacagatcaaccagatgctgagcgacctcaaccgcgtggacttcgccaacgtgcaggagcaggcctcgtgggtgtgccgctgcgaggaccgcgtggtgcagcggctggagcaggacttcaaggtgacgctgcagcagcagaactcgctggagcagtgggcggcctggctggacggcgtggtgagccaggtgctcaagccctaccagggcagcgccggcttccccaaggccgccaagctcttcctcctcaagtggtccttctacagctccatggtgatccgggacctgaccctgcgcagcgccgccagcttcggttccttccacctcatccggctgctctacgacgagtacatgtactacctgatcgagcaccgcgtagcccaggccaagggcgagacccccatcgccgtcatgggcgagttcgccaatctggccacctccctgaaccccctggaccccgacaaagacgaggaggaagaagaggaggaggagagcgaggacgagctgccgcaggacatctcactggcggctggcggcgagtcacccgcgctgggcccggagaccctggagccgccggccaagctggcgcggactgacgcgcgcggcctcttcgtgcaggcgctgccctccagctaagcccttggcctccccgccccacccgcccccgccacccctccacgccagggtcc

SEQ ID NO: 333366 - DNA, 1135 bp, Homo sapiens
gctcgacctggctcacccacgccatggtcaacatcttcgaggagatgctgcgggtgaaggtgccttgacccaagcgatccggaactttgccaagagcctggagagctggctcacccacgccatggtcaacatccccgaggagatgctgcgggtgaaggtgccttgacccaagcgatccggaactttgccaagagcctggagagctggctcacccacgccatggtcaacatccccgaggagatgctgcgggtgaaggtgccttgacccaagcgatccggaactttgccaagagcctggagagctggctcacccacgccatggtcaacatccccgaggagatgctgcgggtgaaggtggccgcggctggcgccttcgcgcagacactgcggcgctacacgtcgctcaaccacctggcgcaggcggcgcgcgctgtgctgcagaacaccgcacagatcaaccagatgctgagcgacctcaaccgcgtggacttcgccaacgtgcaggagcaggcctcgtgggtgtgccgctgcgaggaccgcgtggtgcagcggctggagcaggacttcaaggtgacgctgcagcagcagaactcgctggagcagtgggcggcctggctggacggcgtggtgagccaggtgctcaagccctaccagggcagcgccggcttccccaaggccgccaagctcttcctcctcaagtggtccttctacagctccatggtgatccgggacctgaccctgcgcagcgccgccagcttcggttccttccacctcatccggctgctctacgacgagtacatgtactacctgatcgagcaccgcgtagcccaggccaagggcgagacccccatcgccgtcatgggcgagttcgccaatctggccacctccctgaaccccctggaccccgacaaagacgaggaggaagaagaggaggaggagagcgaggacgagctgccgcaggacatctcactggcggctggcggcgagtcacccgcgctgggcccggagaccctggagccgccggccaagctggcgcggactgacgcgcgcggcctcttcgtgcaggcgctgccctccagctaagcccttggcctccccgccccacccgcccccgccacccctccacgccagggtcc

SEQ ID NO: 333367 - DNA, 1552 bp, Homo sapiens
  misc_feature (446)..(446): n is a, c, g, or t
  misc_feature (1289)..(1289): n is a, c, g, or t
  misc_feature (1305)..(1305): n is a, c, g, or t
  misc_feature (1332)..(1332): n is a, c, g, or t
  misc_feature (1335)..(1335): n is a, c, g, or t
  misc_feature (1368)..(1368): n is a, c, g, or t
  misc_feature (1391)..(1392): n is a, c, g, or t
  misc_feature (1404)..(1404): n is a, c, g, or t
  misc_feature (1449)..(1449): n is a, c, g, or t
  misc_feature (1500)..(1501): n is a, c, g, or t
  misc_feature (1515)..(1515): n is a, c, g, or t
ctgtcaaacacctgactgtattgttctagtcttgatgcctgattactgtccgattatgagactgccatctagtagtgggatatgcattgtgtggctaagtcttaggccacacaatgagtgttgctttccttagccctctgtctcaaaatagtccatctaattctggtccaggcttaagagtgcgtatctcaagcagtgaacgccaggcatttgtacctgtctggagaaacccagagccttgctttatccagatacatcttgggtatgttcacagaaccattaaagtgagggtcagacactcaatacttgatctgaggaaagtctaagttagtgatccctcaggactaatgtatacacacacttcttagggcaacactggccagtctcaggtggatggtaataaggatgctcttcatcggctgtgttttgtttctctgcgttcttcnaagtgggggcccatgggatatacctgattgccttggtggggaaaagctgaagttattttattttattgtctgcagcatcaatagtacctcaccggaagagtgacttgtccaaggttgtggtcagggccctcttcacaggggcctgtgtatcccttatcagtgcctgtatggcaggtaggtgcctcagctctgatggagatactgctgcatgagggtgatggttggaggaataatatgaggaaggtagaattgtccttgagtacaggggcaacaaagattacttccctagatcatgacaggctgtctttcagaatattgatttacccatgcattccacagatacatggcaaaggcacctaatcaagagtgtccacaattcgtgccaaaagaataaagagccttgagaagcacgtgtcagatcttccccttagtacctctgtctcctttatccaggaatcctctatgtccccaggggagctgaagctgactgtgtctccttcccaaacacaagtttcaccaatagaacctatgagacctacatgtgctgcagagggctctttcagagtacttctctgaatggcaccaaccctccttctttttctggtccctgggaagataaggagttcagtgctatggcccttactaactgctgtggattctacaacaataccgtctgtgcctaaggctgcttgatctatttctataacagttttgatcttaaaagctttgtgattgcaaaggtgtttatgtactcagggtgcccacaactcactcaccaagatgtttaacagtaagtaacagtaaatgtaaaagattcattttgggccgggctcagtggctcangcctgtaatcccagcnctttgggaggccgaggcgggcggatcncanggtcaggagatcgagaccatcctggctaacacngtgaaaccccgtctctactaaanntacaaaaaattngccgggagtggtgtcgggcgactgtagtcccagctactcgcgagnctgaggcaggagaatggcgtgaatccgggaggcggagcttgcagcgagccnngatcgcgccactgnactccagcctgggtgacagagcgagactctgtctcag

SEQ ID NO: 333368 - DNA, 534 bp, Homo sapiens
ctccaaattaatattctttttctttccctttgcctctctcctcctccttcgcaatccttctcattcccaggccttctcgttattcatagccttcaacaggaacagcgttgggcaatgaggcccatggtggtttccatgtcattatccctatagtaactcagggaacagttgttttctgagcatcctttcatgttccttgggaaaccatggaaaagactgggggctgtcagtactctggaacttctattgtgattataagaccgcacgcatgggactgaatttatttgcttatttatttttgttttccctaggtgagagctgaaatcattacaacattttcactctgtggatttgccaatcttagttccataggaatcacacttggaggcttgagtgagttcatccattttcccagctccccagtaagacagccagatcccagcttctgtagtgggcagtcctggtgcttcagtacaagctgggatcagatagagaagccattgtgaaatgggcccatttcttaggctgcagtta

SEQ ID NO: 333369 - DNA, 2323 bp, Homo sapiens
gtccttcactgaggagccagagggaatcaattccacaagctgggttgaggagaacaggagatggagaaagcaagtggaagacagtccattgctctgtccacagtggagactggcacagtgaacccggggctggagctcatggaaaaagaagtagagcctgagggaagcaagaggactgacgcacaaggacacagcctgggggatggactgggcccttccacttaccagaggaggagtcggtggcctttcagcaaagcaagaagtttctgcaaaacacacgccagcttgttcaagaagatcctgttgggcctgttgtgtttggcctatgctgcctatctcctggcagcttgcatcttgaatttccagagggcactggccttgtttgtcatcacctgcttggtgatctttgtcctggttcactcgtttttgaaaaagctcctgggcaaaaaattaacaagatgtctgaagccctttgaaaactcccgcctgaggctttggacgaaatgggtgtttgcaggagtctccttggttggccttatactgtggttggctttagacacagcccaaaggccagagcagctgatcccctttgcaggaatctgcatgttcatccttatcctctttgcctgctccaaacaccacagcgcagtgtcctggaggacagtgttttcgggcctaggtcttcaatttgtctttgggatcttggtcatcagaactgatcttggatatactgtatttcagtggctgggagagcaggtccagattttcctgaactacactgtggccggctccagttttgtctttggggatacactggtcaaggatgtctttgcttttcaggccttaccaatcatcattttctttggatgtgtggtgtccattctctactacctgggccttgtgcaatgggtagttcagaaggtcgcctggtttttacaaatcactatgggcaccactgctacagagaccctggctgtggcaggaaacatctttgtgggtatgacagaggcacctctgctcatccgtccctaccttggggacatgacactctctgaaatccatgcggtgatgactggagggtttgccaccatttctggcactgtgctgggagccttcatagcctttggggttgatgcatcatccctgatttctgcctctgtgatggccgccccttgtgctctcgcctcatcaaagctagcgtatccggaagtggaggagtccaagttcaagagtgaggagggggtaaagctgccccgtgggaaggagaggaatgtcctggaagctgccagcaacggagccgtagatgccataggccttgctactaatgtagcagccaacctgattgcctttttggctgtgttggccttcatcaatgctgccctctcctggctgggggaattggtggacatacaggggctcactttccaggtcatctgctcctatctcctaaggcccatggttttcatgatgggtgtagagtggacagactgtccaatggtggctgagatggtgggaatcaagttcttcataaatgagtttgtggcttatcagcaactgtctcaatacaagaacaaacgtctctctggaatggaggagtggattgagggagagaaacagtggatttctgtgagagctgaaatcattacaacattttcactctgtggatttgccaatcttagttccataggaatcacacttggaggcttgacatcaatagtacctcaccggaagagtgacttgtccaaggttgtggtcagggccctcttcacaggggcctgtgtatcccttatcagtgcctgtatggcaggaatcctctatgtccccaggggagctgaagctgactgtgtctccttcccaaacacaagtttcaccaatagaacctatgagacctacatgtgctgcagagggctctttcagagtacttctctgaatggcaccaaccctccttctttttctggtccctgggaagataaggagttcagtgctatggcccttactaactgctgtggattctacaacaataccgtctgtgcctaaggctgcttgatctatttctataacagttttgatcttaaaagctttgtgattgcaaaggtgtttatgtactcagggtgcccacaactcactcaccaagatgtttaacagtaagtaacagtaaatgtaaaagattcattttgggccgggctcaggatgggaatgttttggaacgagatagaggtggtggttgtgcaacattgtgaatattatgtcactgaattgttcactttaaaatggctgtttatgttatgtgaatttcacctcaataaaaaaaatttttagaagg

SEQ ID NO: 333370 - DNA, 2478 bp, Homo sapiens
gtccttcactgaggagccagagggaatcaattccacaagctgggttgaggagaacaggagatggagaaagcaagtggaagacagtccattgctctgtccacagtggagactggcacagtgaacccggggctggagctcatggaaaaagaagtagagcctgagggaagcaagaggactgacgcacaaggacacagcctgggggatggactgggcccttccacttaccagaggaggagtcggtggcctttcagcaaagcaagaagtttctgcaaaacacacgccagcttgttcaagaagatcctgttgggcctgttgtgtttggcctatgctgcctatctcctggcagcttgcatcttgaatttccagagggcactggccttgtttgtcatcacctgcttggtgatctttgtcctggttcactcgtttttgaaaaagctcctgggcaaaaaattaacaagatgtctgaagccctttgaaaactcccgcctgaggctttggacgaaatggtgtcctggaggacagtgttttcgggcctaggtcttcaatttgtctttgggatcttggtcatcagaactgatcttggatatactgtatttcagtggctgggagagcaggtccagattttcctgaactacactgtggccggctccagttttgtctttggggatacactggtcaaggatgtctttgcttttcaggccttaccaatcatcattttctttggatgtgtggtgtccattctctactacctgggccttgtgcaatgggtagttcagaaggtttctgtattcttctaggtcgcctggtttttacaaatcactatgggcaccactgctacagagaccctggctgtggcaggaaacatctttgtgggtatgacagaggcacctctgctcatccgtccctaccttggggacatgacactctctgaaatccatgcggtgatgactggagggtttgccaccatttctggcactgtgctgggagccttcatagcctttggggttgatgcatcatccctgatttctgcctctgtgatggccgccccttgtgctctcgcctcatcaaagctagcgtatccggaagtggaggagtccaagttcaagagtgaggagggggtaaagctgccccgtgggaaggagaggaatgtcctggaagctgccagcaacggagccgtagatgccataggccttgctactaatgtagcagccaacctgattgcctttttggctgtgttggccttcatcaatgctgccctctcctggctgggggaattggtggacatacaggggctcactttccaggtcatctgctcctatctcctaaggcccatggttttcatgatgggtgtagagtggacagactgtccaatggtggctgagatggtgggaatcaagttcttcataaatgagtttgtggcttatcagcaactgtctcaatacaagaacaaacgtctctctggaatggaggagtggattgagggagagaaacagtggatttctgtgagagctgaaatcattacaacattttcactctgtggatttgccaatcttagttccataggaatcacacttggaggcttgacatcaatagtacctcaccggaagagtgacttgtccaaggttgtggtcagggccctcttcacaggggcctgtgtatcccttatcagtgcctgtatggcaggtaggtgcctcagctctgatggagatactgctgcatgagggtgatggttggaggaataatatgaggaaggtagaattgtccttgagtacaggggcaacaaagattacttccctagatcatgacaggctgtctttcagaatattgatttacccatgcattccacagatacatggcaaaggcacctaatcaagagtgtccacaattcgtgccaaaagaataaagagccttgagaagcacgtgtcagatcttccccttagtacctctgtctcctttatccaggaatcctctatgtccccaggggagctgaagctgactgtgtctccttcccaaacacaagtttcaccaatagaacctatgagacctacatgtgctgcagagggctctttcagagtacttctctgaatggcaccaaccctccttctttttctggtccctgggaagataaggagttcagtgctatggcccttactaactgctgtggattctacaacaataccgtctgtgcctaaggctgcttgatctatttctataacagttttgatcttaaaagctttgtgattgcaaaggtgtttatgtactcagggtgcccacaactcactcaccaagatgtttaacagtaagtaacagtaaatgtaaaagattcattttgggccgggctcaggatgggaatgttttggaacgagatagaggtggtggttgtgcaacattgtgaatattatgtcactgaattgttcactttaaaatggctgtttatgttatgtgaatttcacctcaataaaaaaaatttttagaagg

SEQ ID NO: 333371 - DNA, 1083 bp, Homo sapiens
  misc_feature (820)..(820): n is a, c, g, or t
  misc_feature (836)..(836): n is a, c, g, or t
  misc_feature (863)..(863): n is a, c, g, or t
  misc_feature (866)..(866): n is a, c, g, or t
  misc_feature (899)..(899): n is a, c, g, or t
  misc_feature (922)..(923): n is a, c, g, or t
  misc_feature (935)..(935): n is a, c, g, or t
  misc_feature (980)..(980): n is a, c, g, or t
  misc_feature (1031)..(1032): n is a, c, g, or t
  misc_feature (1046)..(1046): n is a, c, g, or t
ctccaaattaatattctttttctttccctttgcctctctcctcctccttcgcaatccttctcattcccaggccttctcgttattcatagccttcaacaggaacagcgttgggcaatgaggcccatggtggtttccatgtcattatccctatagtaactcagggaacagttgttttctgagcatcctttcatgttccttgggaaaccatggaaaagactgggggctgtcagtactctggaacttctattgtgattataagaccgcacgcatgggactgaatttatttgcttatttatttttgttttccctaggtgagagctgaaatcattacaacattttcactctgtggatttgccaatcttagttccataggaatcacacttggaggcttgagtgagttcatccattttcccagctccccagtaagacagccagatcccagcttctgtagtgggcagtcctggtgcttcagtacaagtgatatgttttgttgctttgttcctgtctgaccccttatgtacctctctggtttttcactgcagtacttctctgaatggcaccaaccctccttctttttctggtccctgggaagataaggagttcagtgctatggcccttactaactgctgtggattctacaacaataccgtctgtgcctaaggctgcttgatctatttctataacagttttgatcttaaaagctttgtgattgcaaaggtgtttatgtactcagggtgcccacaactcactcaccaagatgtttaacagtaagtaacagtaaatgtaaaagattcattttgggccgggctcagtggctcangcctgtaatcccagcnctttgggaggccgaggcgggcggatcncanggtcaggagatcgagaccatcctggctaacacngtgaaaccccgtctctactaaanntacaaaaaattngccgggagtggtgtcgggcgactgtagtcccagctactcgcgagnctgaggcaggagaatggcgtgaatccgggaggcggagcttgcagcgagccnngatcgcgccactgnactccagcctgggtgacagagcgagactctgtctcag

SEQ ID NO: 333372 - DNA, 318 bp, Homo sapiens
gacagttagacatctatcctggcctcaagaagtgcagttctgtctgacagtagggctgggtggcaaggtctctggagggtttttcttgctctaagtcccaggcattcatgactggagtttcatttgcccattggaagcactgccttgctgatctttactctgcttcttctctttttagcctatgctgcctatctcctggcagcttgcatcttgaatttccagagggcactggccttgtttgtcatcacctgcttggtgatctttgtcctggttcactcgtttttgaaaaagctcctgggcaaaaaattaacaagatgt

SEQ ID NO: 333373 - DNA, 2460 bp, Homo sapiens
  misc_feature (2197)..(2197): n is a, c, g, or t
  misc_feature (2213)..(2213): n is a, c, g, or t
  misc_feature (2240)..(2240): n is a, c, g, or t
  misc_feature (2243)..(2243): n is a, c, g, or t
  misc_feature (2276)..(2276): n is a, c, g, or t
  misc_feature (2299)..(2300): n is a, c, g, or t
  misc_feature (2312)..(2312): n is a, c, g, or t
  misc_feature (2357)..(2357): n is a, c, g, or t
  misc_feature (2408)..(2409): n is a, c, g, or t
  misc_feature (2423)..(2423): n is a, c, g, or t
gtccttcactgaggagccagagggaatcaattccacaagctgggttgaggagaacaggagatggagaaagcaagtggaagacagtccattgctctgtccacagtggagactggcacagtgaacccggggctggagctcatggaaaaagaagtagagcctgagggaagcaagaggactgacgcacaaggacacagcctgggggatggactgggcccttccacttaccagaggaggagtcggtggcctttcagcaaagcaagaagtttctgcaaaacacacgccagcttgttcaagaagatcctgttgggcctgttgtgtttggcctatgctgcctatctcctggcagcttgcatcttgaatttccagagggcactggccttgtttgtcatcacctgcttggtgatctttgtcctggttcactcgtttttgaaaaagctcctgggcaaaaaattaacaagatgtctgaagccctttgaaaactcccgcctgaggctttggacgaaatgggtgtttgcaggagtctccttggttggccttatactgtggttggctttagacacagcccaaaggccagagcagctgatcccctttgcaggaatctgcatgttcatccttatcctctttgcctgctccaaacaccacagcgcagtgtcctggaggacagtgttttcgggcctaggtcttcaatttgtctttgggatcttggtcatcagaactgatcttggatatactgtatttcagtggctgggagagcaggtccagattttcctgaactacactgtggccggctccagttttgtctttggggatacactggtcaaggatgtctttgcttttcaggccttaccaatcatcattttctttggatgtgtggtgtccattctctactacctgggccttgtgcaatgggtagttcagaaggtcgcctggtttttacaaatcactatgggcaccactgctacagagaccctggctgtggcaggaaacatctttgtgggtatgacagaggcacctctgctcatccgtccctaccttggggacatgacactctctgaaatccatgcggtgatgactggagggtttgccaccatttctggcactgtgctgggagccttcatagcctttggggttgatgcatcatccctgatttctgcctctgtgatggccgccccttgtgctctcgcctcatcaaagctagcgtatccggaagtggaggagtccaagttcaagagtgaggagggggtaaagctgccccgtgggaaggagaggaatgtcctggaagctgccagcaacggagccgtagatgccataggccttgctactaatgtagcagccaacctgattgcctttttggctgtgttggccttcatcaatgctgccctctcctggctgggggaattggtggacatacaggggctcactttccaggtcatctgctcctatctcctaaggcccatggttttcatgatgggtgtagagtggacagactgtccaatggtggctgagatggtgggaatcaagttcttcataaatgagtttgtggcttatcagcaactgtctcaatacaagaacaaacgtctctctggaatggaggagtggattgagggagagaaacagtggatttctgtgagagctgaaatcattacaacattttcactctgtggatttgccaatcttagttccataggaatcacacttggaggcttgacatcaatagtacctcaccggaagagtgacttgtccaaggttgtggtcagggccctcttcacaggggcctgtgtatcccttatcagtgcctgtatggcaggaatcctctatgtccccaggggagctgaagctgactgtgtctccttcccaaacacaagtttcaccaatagaacctatgagacctacatgtgctgcagagggctctttcagagtacttctctgaatggcaccaaccctccttctttttctggtccctgggaagataaggagttcagtgctatggcccttactaactgctgtggattctacaacaataccgtctgtgcctaaggctgcttgatctatttctataacagttttgatcttaaaagctttgtgattgcaaaggtgtttatgtactcagggtgcccacaactcactcaccaagatgtttaacagtaagtaacagtaaatgtaaaagattcattttgggccgggctcagtggctcangcctgtaatcccagcnctttgggaggccgaggcgggcggatcncanggtcaggagatcgagaccatcctggctaacacngtgaaaccccgtctctactaaanntacaaaaaattngccgggagtggtgtcgggcgactgtagtcccagctactcgcgagnctgaggcaggagaatggcgtgaatccgggaggcggagcttgcagcgagccnngatcgcgccactgnactccagcctgggtgacagagcgagactctgtctcag

SEQ ID NO: 333374 - DNA, 330 bp, Homo sapiens
tgttcagacacctcactttacagacaaaagcagaggcctagagagggaagggagacgttcaaggtcacacagcatctatggaagagccaactgcatggctgggcttcctggccccaagcccgctcctgccccttgcccgcttttcttctgttgtattcctctgatactctctctgccctgggaccagggagggatgcagctttgaaagaagcacacattctgaagtttttttgcctctgcccaagcagagttctagcttctggttttctcgaaggccctcggtcgggcaggtccttctccctgctgtttgttccagctcagacctatatg

SEQ ID NO: 333375 - DNA, 1504 bp, Homo sapiens
  misc_feature (62)..(62): n is a, c, g, or t
atcatgttggccaggatggtctcgaactcctgacctcatgatccgcctgcctcggcctcccnaaagtgctgggattacaggcatgagccaccgcgcccagctgacagtactttttatgtgaagaacaattaagatggtttgtgatataactggaggtgcctaactacaaaacactggctgcagctggaataaatctcagcggttcttacaaagcatggactatctggaagaatagcaagttatttctgtctttttctgcatgttttctttacttctttccaagaaacctgtatttacaggatctttcctcttggtaggtacctgtttgatatatcagttacatcaattagttacttcccctggttccacagttctctccagactgttctctccacaataatggcataataatagtttatgcctgtggttcattgaacacgtgctcgtgccctatactgtgctgttttgtttttgtttttttccatgacatgccatgattctcaactgtgttgttttaaatacactgttctttcttcacaacagtcctgcctcaggaccttggtatatctatctatgccctctacctgaaagtttttgccaggcatcctcccatgcatccctcaagattctaagaaatcactctgattctccagactatttgtaaccctccatcacacacaacactttttttttttctttataggactggtcatataaaaaaatcattacacagtttttaatgtctgaattccctggtagatttaaagttactgctttgacaacttggactgtttcttagaatgctacatccttcacacttagaatggtgcttggtgcatatgaggtgctcaataaacagttgttgaacaaacactatatgaggtaagtactacagtatctccattttagaaaggaggaagctgaagagcgaagaagttaacttgctcagtattacttcactagaaagtaggggagttgatattaaaaaaaaatctaccacatattccggagacctttagttttacatagagctcttctcccacaaactacttagatggctgattaagagtactggtaaaaagttataaaggaagtggtgtgacaaaaaaatatctaggacctctgggatgaggaggaaaaccttggggactgaagggcttgaaggaactttaaggtcagttaacaaatggtatgtcaaaggtattatacaaagaagaatgaaaatacttataaagtggactacagtcttgaaggagaattgggggatcacttttgaagctgccactaaatgcagtgttacttcttgcaggaaatggttaatgccactcatcaagaaccatacttctggaagtctaatgtagagaggattaaagcataatgggccttgtagtcagacttccggatcagacttccagctctgctacttactagctatgagatctctgggaagtttcttaacctcactgtgcttcagttttctcatccacagaaatcagaaataagt

SEQ ID NO: 333376 - DNA, 2826 bp, Homo sapiens
tgcgtttctgcgtttccgcctttccttttgtttgtctcacgttttgcgtgggaggcggtcccgggatttcaggggtctaccggctctcttatggcgaatgcaacccgaagagagagtgaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccagaagtctggacagctgatcacctgaaagagaggagccaagaaaatcaatctaaacatttgtgggaagttgtattcatcaataatgaaatgctgactaaggaacaaggtaatgtaataggaataccatttaacatggacgtaagttcttttccttccagaaaaatgttctgtcagtatgactcatgtggaatgagtttcaacactgtttcagaattggttatcagtaagataaactatttaggaaaaaagtctgacgaatttaatgcatgtgggaaattgttactcaatattaagcatgatgaaactcatactcgagagaaaaatgaagttttgaaaaataggaacactctgagtcatcgtgagaacactttgcagcatgagaagattcaaactttagaccacaattttgaatacagtatatgtcaggaaaccctccttgaaaaggcagtattcaatacacggaagagagagaatgcagaagagaataactgtgactataatgaatttgggagaactttctgtgatagttcatccctcttgttccatcagatacctccatcaaaggacagtcactatgaatttagtgattgtgagaagttcttatgtgtgaagtccaccctttctaaacatgatggggtacctgtgaaacactatgattgtggtgaaagtgggaataatttcaggaggaaattgtgtctgtcacagcttcagaaaggtgataaaggagagaaacactttgaatgtaatgaatgtgggaaagctttctgggagaagtcacatctcactcgacatcagagggtgcacacaggagagaaacactttcaatgtaatcaatgtggaaaaactttctgggagaagtcaaacctcactaaacatcagagatcacacacaggggagaaaccttttgaatgcaatgaatgtgggaaagcctttagccataagtcagccctcacattacaccagagaacacatacaggggagaaaccctatcagtgtaatgcatgtgggaaaactttttaccagaaatctgacctcactaaacatcagagaacacacacagggcagaaaccctatgaatgttatgaatgtggaaaatccttctgtatgaattcacaccttacagtacaccagagaactcacacaggtgagaaaccttttgaatgtcttgagtgtgggaaatccttttgtcaaaagtcacatcttacacagcatcagagaactcacataggagataaaccttatgaatgtaatgcatgtgggaaaactttctaccacaagtcagtactcaccaggcatcagataattcatacagggttgaaaccttatgaatgttatgaatgtgggaaaaccttctgcttgaagtcagacctcacaatacatcagagaacgcacacaggggagaaaccctttgcatgtcctgaatgtgggaaattctttagccataagtcaaccctctctcaacattatagaacacacacgggggagaaaccctatgaatgtcatgaatgtggaaaaatcttttacaataaatcatacctaacaaaacataatagaacacatacaggggagaaaccctatgaatgtaatgaatgtggaaaaaccttctgccagaagtcacaactcactcagcatcagagaattcacataggggagaaaccctatgaatgtaatgagtgtggaaaagctttctgccataagtcagctctaattgtacatcagagaacccatacacaagaaaagccttataaatgtaacgaatgtggaaaatctttctgtgtgaagtcaggacttattttacatgagagaaagcacacgggggagaaaccctatgaatgcaatgaatgtgggaaatccttcagtcacaaatcatcactcacagtacatcacagggctcacacaggagagaaatcttgtcagtgtaatgaatgtggaaaaatcttttaccgtaaatcagaccttgctaaacatcagagatcacatacaggggaaaagccctatgaatgtaacacatgcaggaaaaccttctctcaaaagtcaaatctcattgtacatcagagaacacacataggagaaaaaccttatgaatgaattggatattagaaatttccagccacaagtcagcctccataatgcctcagagtcttcacactgtggagaagggcctgttgacatcctgaatgttcaataactatccacaaactcgccttatgttactccaaagtaacagtaggggataaacccatagactacaacaactataggatggcttttgttaggaagtgatattctgttgaatatcagatggttaatactggcataaaacctcacagatttttttgaatttgtgaaagtttttggcaaaactacaaataggattatgttagcgtttacactgaggagaaaattgtcaatttaagaaatctaaagtgaaaattttgcttagaaataaaatatgacaagttctgt

SEQ ID NO: 333377 - DNA, 2886 bp, Homo sapiens
atggtttgcgtgcactctgtgtgtgtacgtgtatgtgtgtgtgtgtggttataacaaactggtacttttacatttgagtaaccatcaacacaattagtttacagaatggaaaaggagtctgagatctgtactgtttcaggattacaaaggaatcaggatttagcctcaagtagttcccttgttgtattaataaccacaccctttctgcatccctgtccctggcatccacttgactatgaagctttttgtaaagcatagataaattgaataatcagggcaacagcattaagcacatctgtgaattatccctgaagttcataggacttacatatgtacaagtggtatgtgatataaatcgtgtgtttcatatgcataatggtatttaacgtaattgtgaataggaagtaggtatcctaatttagtagtggttacttcatcaggcccatcccaggtgtttgtcgtgtcctgaaacaatttaaatagagacccacagagctaatgtttatccatttaaaagttataaatcaaaataacagattatctgaaaaaaaatctatcctgtacgtgtgaagatctaggcctgcctccatgttactccctttctcttactacctgtggctcatcccatgccatgaactgcctggggtacatatgtgaacactccagccttcagcgtaagtgatagtccaaattttctttaagcagctgctctccaagacagggccctggaaagaggcccacacatacagcccagttgctgcccagggctgttggactgtcatttcattgctcattgtacccagacagggatctgggccttcagagacttttgagaatatgaagaggagggttgaggctggagaagagccagaatcaagctggcatggggcttttattgacagtgtgaagattgtacactacattacatgatcagatcatacaaataatctaagattttacagtctggtgaccctagattacacaagtaatctaagcttccactttggaaaactagaaaaagaagagcaaattaaatccaaagtaacctggaaaaaaattagagtaaaaatcagtgaaattgaaaagagaaaatcaataaaacccaaaactgttctttgaaaaggtgggtaaaattgataaacctctagctagattaagaaaaaacagaagacaaatactgctaataccaaaagtgaaagaggccatcatagctgatcctatggtcaccaaaaggattagaaagaaatatggacaactctgtccataaatttgataacttagctaaaatggatcaattccttgcaagatgcattctctcaaagctcataaaaggtagatctcagtaggcatatatatctattaaataaattgaagcagtaattaataaccttccaagaccaggcgcggtggctaaaaatacaaaaagttagccgggcgtggtggcatgcgtgtatagtccaagctactcaggaggctgaggcagaagaatcacttgaacctgggaggtggaggttgcagtgagccaagattgtgccactgtactccagcctgggtgacagagtgagactccatctcaataaaattaataataataaaaccttccaaaaaaagtgccgggaccaaatggattcactgatgtgcatttttcgagatacttaaggtagaaatgataccaagtctgtactgtctctttcagaaaataaaagcagggataacacttcccaaatcattttgtgaggccaggattaccctaataccaaagccaggcaaaaacattacaagaaaggaaaactacagatcaatatttccagtgaacacagatgcagaaatccttaaaatgttagcaaatcaggaatgcaagccttgttcaacatttgatattcagtgcaatccattgcatgcattagcagttcaaagattaaatatgatcatatcaataggtacagaaaaagcatttgacaaaatccaatatccattcatgataaaacctctcaacacagaaggaatacaggagaacttactcaatttgataaagaactactacaaaaaaccctacatctagcatcatccttgatgtttccaactaaatgctttcctactaagatcaggaacatggcaaggaacaccactgcttttcagcattgtactggaagtgctatctaatgcagtgataccaaaaaaaaaggaaataaaatgcacataaatttggaaggaggaaatacaactgtctttgttctcaaataacatgattgtctttgtagaaaattctaaataacaaaaacctgctgacattaataagcaattatagcagggttgtagaatgtagtcctcaggtatatgataaaaaagaattagacatcaagtcattaaaagacatataggaaccctaaatgcttattgttaagtgaaaaccaatctgaaaaggctttctatgttgtatgattgcaattatatgacattctgggagaggcaaaactatcgagcgagtcaaaggaccagtggttgctgagagttgaggggaaaggagggatggcaggtaggtgatttttaggacagtgaaagtactctgtagggtactgtaatttgtcaaaatgcagagaatggaaaacagtgaacggaaaacacagagtaaaccctagtgtcaactctggacttcagttaataacagtgtaccactattggctcatcaattgtaacaaatgaaccataatgatgcaagatgttaataattggggagcctgtggaggatgggagggttaaaggtttatatgagaattctctgtactttttgctcaatttttctgtaaccctaaagctgctctaaaaaatgaagtgtattaagtaaataaataagtaaataaccaaccaaccctgaggaacatcttg

SEQ ID NO: 333378 - DNA, 2828 bp, Homo sapiens
atggtttgcgtgcactctgtgtgtgtacgtgtatgtgtgtgtgtgtggttataacaaactggtacttttacatttgagtaaccatcaacacaattagtttacagaatggaaaaggagtctgagatctgtactgtttcaggattacaaaggaatcaggatttagcctcaagtagttcccttgttgtattaataaccacaccctttctgcatccctgtccctggcatccacttgactatgaagctttttgtaaagcatagataaattgaataatcagggcaacagcattaagcacatctgtgaattatccctgaagttcataggacttacatatgtacaagtggtatgtgatataaatcgtgtgtttcatatgcataatggtatttaacgtaattgtgaataggaagtaggtatcctaatttagtagtggttacttcatcaggcccatcccaggtgtttgtcgtgtcctgaaacaatttaaatagagacccacagagctaatgtttatccatttaaaagttataaatcaaaataacagattatctgaaaaaaaatctatcctgtacgtgtgaagatctaggcctgcctccatgttactccctttctcttactacctgtggctcatcccatgccatgaactgcctggggtacatatgtgaacactccagccttcagcgtaagtgatagtccaaattttctttaagcagctgctctccaagacagggccctggaaagaggcccacacatacagcccagttgctgcccagggctgttggactgtcatttcattgctcattgtacccagacagggatctgggccttcagagacttttgagaatatgaagaggagggttgaggctggagaagagccagaatcaagctggcatggggcttttattgacagtgtgaagattgtacactacattacatgatcagatcatacaaataatctaagattttacagtctggtgaccctagattacacaagtaatctaagcttccactttggaaaactagaaaaagaagagcaaattaaatccaaagtaacctggaaaaaaattagagtaaaaatcagtgaaattgaaaagagaaaatcaataaaacccaaaactgttctttgaaaaggtgggtaaaattgataaacctctagctagattaagaaaaaacagaagacaaatactgctaataccaaaagtgaaagaggccatcatagctgatcctatggtcaccaaaaggattagaaagaaatatggacaactctgtccataaatttgataacttagctaaaatggatcaattccttgcaagatgcattctctcaaagctcataaaaggtagatctcagtaggcatatatatctattaaataaattgaagcagtaattaataaccttccaagaccaggcgcggtggctaaaaatacaaaaagttagccgggcgtggtggcatgcgtgtatagtccaagctactcaggaggctgaggcagaagaatcacttgaacctgggaggtggaggttgcagtgagccaagattgtgccactgtactccagcctgggtgacagagtgagactccatctcaataaaattaataataataaaaccttccaaaaaaagtgccgggaccaaatggattcactgatgtgcatttttcgagatacttaaggtagaaatgataccaagtctgtactgtctctttcagaaaataaaagcagggataacacttcccaaatcattttgtgaggccaggattaccctaataccaaagccaggcaaaaacattacaagaaaggaaaactacagatcaatatttccagtgaacacagatgcagaaatccttaaaatgttagcaaatcaggaatgcaagccttgttcaacatttgatattcagtgcaatccattgcatgcattagcagttcaaagattaaatatgatcatatcaataggtacagaaaaagcatttgacaaaatccaatatccattcatgataaaacctctcaacacagaaggaatacaggagaacttactcaatttgataaagaactactacaaaaaaccctacatctagcatcatccttgatgtttccaactaaatgctttcctactaagatcaggaacatggcaaggaacaccactgcttttcagcattgtactggaagtgctatctaatgcagtgataccatctcaaataacatgattgtctttgtagaaaattctaaataacaaaaacctgctgacattaataagcaattatagcagggttgtagaatgtagtcctcaggtatatgataaaaaagaattagacatcaagtcattaaaagacatataggaaccctaaatgcttattgttaagtgaaaaccaatctgaaaaggctttctatgttgtatgattgcaattatatgacattctgggagaggcaaaactatcgagcgagtcaaaggaccagtggttgctgagagttgaggggaaaggagggatggcaggtaggtgatttttaggacagtgaaagtactctgtagggtactgtaatttgtcaaaatgcagagaatggaaaacagtgaacggaaaacacagagtaaaccctagtgtcaactctggacttcagttaataacagtgtaccactattggctcatcaattgtaacaaatgaaccataatgatgcaagatgttaataattggggagcctgtggaggatgggagggttaaaggtttatatgagaattctctgtactttttgctcaatttttctgtaaccctaaagctgctctaaaaaatgaagtgtattaagtaaataaataagtaaataaccaaccaaccctgaggaacatcttg

SEQ ID NO: 333379 - DNA, 2871 bp, Homo sapiens
atggtttgcgtgcactctgtgtgtgtacgtgtatgtgtgtgtgtgtggttataacaaactggtacttttacatttgagtaaccatcaacacaattagtttacagaatggaaaaggagtctgagatctgtactgtttcaggattacaaaggaatcaggatttagcctcaagtagttcccttgttgtattaataaccacaccctttctgcatccctgtccctggcatccacttgactatgaagctttttgtaaagcatagataaattgaataatcagggcaacagcattaagcacatctgtgaattatccctgaagttcataggacttacatatgtacaagtggtatgtgatataaatcgtgtgtttcatatgcataatggtatttaacgtaattgtgaataggaagtaggtatcctaatttagtagtggttacttcatcaggcccatcccaggtgtttgtcgtgtcctgaaacaatttaaatagagacccacagagctaatgtttatccatttaaaagttataaatcaaaataacagattatctgaaaaaaaatctatcctgtacgtgtgaagatctaggcctgcctccatgttactccctttctcttactacctgtggctcatcccatgccatgaactgcctggggtacatatgtgaacactccagccttcagcgtaagtgatagtccaaattttctttaagcagctgctctccaagacagggccctggaaagaggcccacacatacagcccagttgctgcccagggctgttggactgtcatttcattgctcattgtacccagacagggatctgggccttcagagacttttgagaatatgaagaggagggttgaggctggagaagagccagaatcaagctggcatggggcttttattgacagtgtgaagattgtacactacattacatgatcagatcatacaaataatctaagattttacagtctggtgaccctagattacacaagtaatctaagcttccactttggaaaactagaaaaagaagagcaaattaaatccaaagtaacctggaaaaaaattagagtaaaaatcagtgaaattgaaaagagaaaatcaataaaacccaaaactgttctttgaaaaggtgggtaaaattgataaacctctagctagattaagaaaaaacagaagacaaatactgctaataccaaaagtgaaagaggccatcatagctgatcctatggtcaccaaaaggattagaaagaaatatggacaactctgtccataaatttgataacttagctaaaatggatcaattccttgcaagatgcattctctcaaagctcataaaaggtagatctcagtaggcatatatatctattaaataaattgaagcagtaattaataaccttccaagaccaggcgcggtggctaaaaatacaaaaagttagccgggcgtggtggcatgcgtgtatagtccaagctactcaggaggctgaggcagaagaatcacttgaacctgggaggtggaggttgcagtgagccaagattgtgccactgtactccagcctgggtgacagagtgagactccatctcaataaaattaataataataaaaccttccaaaaaaagtgccgggaccaaatggattcactgatgtgcatttttcgagatacttaaggtagaaatgataccaagtctgtactgtctctttcagaaaataaaagcagggataacacttcccaaatcattttgtgaggccaggattaccctaataccaaagccaggcaaagaaaactacagatcaatatttccagtgaacacagatgcagaaatccttaaaatgttagcaaatcaggaatgcaagccttgttcaacatttgatattcagtgcaatccattgcatgcattagcagttcaaagattaaatatgatcatatcaataggtacagaaaaagcatttgacaaaatccaatatccattcatgataaaacctctcaacacagaaggaatacaggagaacttactcaatttgataaagaactactacaaaaaaccctacatctagcatcatccttgatgtttccaactaaatgctttcctactaagatcaggaacatggcaaggaacaccactgcttttcagcattgtactggaagtgctatctaatgcagtgataccaaaaaaaaaggaaataaaatgcacataaatttggaaggaggaaatacaactgtctttgttctcaaataacatgattgtctttgtagaaaattctaaataacaaaaacctgctgacattaataagcaattatagcagggttgtagaatgtagtcctcaggtatatgataaaaaagaattagacatcaagtcattaaaagacatataggaaccctaaatgcttattgttaagtgaaaaccaatctgaaaaggctttctatgttgtatgattgcaattatatgacattctgggagaggcaaaactatcgagcgagtcaaaggaccagtggttgctgagagttgaggggaaaggagggatggcaggtaggtgatttttaggacagtgaaagtactctgtagggtactgtaatttgtcaaaatgcagagaatggaaaacagtgaacggaaaacacagagtaaaccctagtgtcaactctggacttcagttaataacagtgtaccactattggctcatcaattgtaacaaatgaaccataatgatgcaagatgttaataattggggagcctgtggaggatgggagggttaaaggtttatatgagaattctctgtactttttgctcaatttttctgtaaccctaaagctgctctaaaaaatgaagtgtattaagtaaataaataagtaaataaccaaccaaccctgaggaacatcttg

SEQ ID NO: 333380 - DNA, 1590 bp, Homo sapiens
tgcgtttctgcgtttccgcctttccttttgtttgtctcacgttttgcgtgggaggcggtcccgggatttcaggggtctaccggctctcttatggcgaatgcaacccgaagagagagtgagctgtatcttcagagttgtctccgtctttccaagaacagaacaaaatgaacaaggtaagttgtttattaattccctactttattttgcggtggactttgtgagatttgtaagagtcagtatggtttttttgttttgttttgtttagtgagactccatctcaataaaattaataataataaaaccttccaaaaaaagtgccgggaccaaatggattcactgatgtgcatttttcgagatacttaaggtagaaatgataccaagtctgtactgtctctttcagaaaataaaagcagggataacacttcccaaatcattttgtgaggccaggattaccctaataccaaagccaggcaaaaacattacaagaaaggaaaactacagatcaatatttccagtgaacacagatgcagaaatccttaaaatgttagcaaatcaggaatgcaagccttgttcaacatttgatattcagtgcaatccattgcatgcattagcagttcaaagattaaatatgatcatatcaataggtacagaaaaagcatttgacaaaatccaatatccattcatgataaaacctctcaacacagaaggaatacaggagaacttactcaatttgataaagaactactacaaaaaaccctacatctagcatcatccttgatgtttccaactaaatgctttcctactaagatcaggaacatggcaaggaacaccactgcttttcagcattgtactggaagtgctatctaatgcagtgataccaaaaaaaaaggaaataaaatgcacataaatttggaaggaggaaatacaactgtctttgttctcaaataacatgattgtctttgtagaaaattctaaataacaaaaacctgctgacattaataagcaattatagcagggttgtagaatgtagtcctcaggtatatgataaaaaagaattagacatcaagtcattaaaagacatataggaaccctaaatgcttattgttaagtgaaaaccaatctgaaaaggctttctatgttgtatgattgcaattatatgacattctgggagaggcaaaactatcgagcgagtcaaaggaccagtggttgctgagagttgaggggaaaggagggatggcaggtaggtgatttttaggacagtgaaagtactctgtagggtactgtaatttgtcaaaatgcagagaatggaaaacagtgaacggaaaacacagagtaaaccctagtgtcaactctggacttcagttaataacagtgtaccactattggctcatcaattgtaacaaatgaaccataatgatgcaagatgttaataattggggagcctgtggaggatgggagggttaaaggtttatatgagaattctctgtactttttgctcaatttttctgtaaccctaaagctgctctaaaaaatgaagtgtattaagtaaataaataagtaaataaccaaccaaccctgaggaacatcttg

SEQ ID NO: 333381 - DNA, 1496 bp, Homo sapiens
acactggagagaagcctcacaaatgtgaggtatgtggaatggccttccatcatagttcagtcctgaggcagcacaaaagaacacacacagggcagaaaccctatgaatgttatgaatgtggaaaatccttctgtatgaattcacaccttacagtacaccagagaactcacacaggtgagaaaccttttgaatgtcttgagtgtgggaaatccttttgtcaaaagtcacatcttacacagcatcagagaactcacataggagataaaccttatgaatgtaatgcatgtgggaaaactttctaccacaagtcagtactcaccaggcatcagataattcatacagggttgaaaccttatgaatgttatgaatgtgggaaaaccttctgcttgaagtcagacctcacaatacatcagagaacgcacacaggggagaaaccctttgcatgtcctgaatgtgggaaattctttagccataagtcaaccctctctcaacattatagaacacacacgggggagaaaccctatgaatgtcatgaatgtggaaaaatcttttacaataaatcatacctaacaaaacataatagaacacatacaggggagaaaccctatgaatgtaatgaatgtggaaaaaccttctgccagaagtcacaactcactcagcatcagagaattcacataggggagaaaccctatgaatgtaatgagtgtggaaaagctttctgccataagtcagctctaattgtacatcagagaacccatacacaagaaaagccttataaatgtaacgaatgtggaaaatctttctgtgtgaagtcaggacttattttacatgagagaaagcacacgggggagaaaccctatgaatgcaatgaatgtgggaaatccttcagtcacaaatcatcactcacagtacatcacagggctcacacaggagagaaatcttgtcagtgtaatgaatgtggaaaaatcttttaccgtaaatcagaccttgctaaacatcagagatcacatacaggggaaaagccctatgaatgtaacacatgcaggaaaaccttctctcaaaagtcaaatctcattgtacatcagagaacacacataggagaaaaaccttatgaatgaattggatattagaaatttccagccacaagtcagcctccataatgcctcagagtcttcacactgtggagaagggcctgttgacatcctgaatgttcaataactatccacaaactcgccttatgttactccaaagtaacagtaggggataaacccatagactacaacaactataggatggcttttgttaggaagtgatattctgttgaatatcagatggttaatactggcataaaacctcacagatttttttgaatttgtgaaagtttttggcaaaactacaaataggattatgttagcgtttacactgaggagaaaattgtcaatttaagaaatctaaagtgaaaattttgcttagaaataaaatatgacaagttctgt

SEQ ID NO: 333382 - DNA, 1015 bp, Homo sapiens
tgcgtttctgcgtttccgcctttccttttgtttgtctcacgttttgcgtgggaggcggtcccgggatttcaggggtctaccggctctcttatggcgaatgcaacccgaagagagagtgagctgtatcttcagagttgtctccgtctttccaagaacagaacaaaatgaacaaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccaggctcctcttggctatggtggtttcccagactttccttgttttggatgaccttgacagtttggaggaatcctggtgagaagtctggacagctgatcacctgaaagagaggagccaagaaaatcaatctaaacatttgtgggaagttgtattcatcaataatgaaatgctgactaaggaacaaggtaatgtaataggaataccatttaacatggacgtaagttcttttccttccagaaaaatgttctgtcagtatgactcatgtggaatgagtttcaacactgtttcagaattggttatcagtaagataaactatttaggaaaaaagtctgacgaatttaatgcatgtgggaaattgttactcaatattaagcatgatgaaactcatactcgagagaaaaatgaagttttgaaaaataggaacactctgagtcatcgtgagaacctggcgatgacgagattacagttgaccgattgaacagcagtcagacccctgaagggaccaaacggaaagcagggaagaacgggcatgatgggacggaagaccctggaaaacccagagggaacgaggagggggagccccagggctacacggggcacgagc

SEQ ID NO: 333383 - DNA, 1250 bp, Homo sapiens
aaaagcttgaaggaggacacctgtctgtggtttagtgatggcatcacttttgtctccctcctttggttaagcattctgtaggaaaacacaagaaaagagggctttcaggccatcttcacatcaaccctaagacagacattttcaaatattgttctcaccatgcttactccctcccaggcccctgaggtgttcatgcactgatcctggaccttggattaaacccttgcagtgctggaagaagaggactctgcactgcctgccacaccaggactggaagatcaatggccttcccttcttccaaactaccttcccatgaggtggggatggtggtcacatctccaacactggcgtgctgtggaagagacatcagcattctctgcaacaaatttggaaacagcctaaagagacgtttctacttcaaagagatgcactgaggaagtgcactggcactgctggggactcacctggggcccagggctgaggcttctcgtgtccttggagctgctgtcctcccgaggagcgtccacactgcagccagctcagcctcaggtgtcctatctggttttgaaaccaaatctaagtgggaaaagaagattcaagttttatccgatttagtctacataattttaagtatctatttgagctcaacaccaagaatcacttccttctctgtcccatctgtggtctccaaaggaaaggtccctgggttaggagacactggctagcatcctaaagccagagctggccgatgggtgtgtgtccactcttccttcacctcttccccaccctacagttgtttttgtctcatgctcacttgctctttctgcctccctctcactctttaggtctcacaaaggctttggtcaaggactgactgactttccttggctctctgtcatctccccataatcaaaggcatttcataacacacaatccatgtgaagggacctctgatcaaaattcacttaaagaggagctcactaattaccagtacttactgctgagcctggaatcattcgtatataccccagagttcattcattccagacacagtactagataaggagactcctatgagccaaaaacctaactctgaatagactgtgactgtcataatcaaaccctgtggtcccagctactcagaaggctgaggcaggagaattgcttgaacccggaggcggaagttgcatgagctgagatcctgtcattgcactccagtctgggggacaagagcgagacttcatctcaaa

SEQ ID NO: 333384 - DNA, 1090 bp, Homo sapiens
tgcgtttctgcgtttccgcctttccttttgtttgtctcacgttttgcgtgggaggcggtcccgggatttcaggggtctaccggctctcttatggcgaatgcaacccgaagagagagtgagctgtatcttcagagttgtctccgtctttccaagaacagaacaaaatgaacaaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccaggctcctcttggctatggtggtttcccagactttccttgttttggatgaccttgacagtttggaggaatcctggtgagaagtctggacagctgatcacctgaaagagaggagccaagaaaatcaatctaaacatttgtgggaagttgtattcatcaataatgaaatgctgactaaggaacaagatgtcatcagcctcaggagagagtggtatgtaccttgaaataactcaccgagacacaaacttgctgacttcttgtcctccatctcagagaagatatggaagatatgaaggatggagaaaaagaggaagaggaaatgtgatggtggagtgggtaacataaaaaagggaaggcaaataagtgtatgtgttttcagcggcttctcactttcttttggcccatcaaggaaaccaacacatccgaggagagtgctgataggctgctcttagccgggaccacacttgtgctttgaaaacaacccccaaaatccctgcaggcaattgaaggatgtcccgagaacatcctcccagggagcagatacccattctgtagaagctctaagcctgctgggctaagccctccataggccactttaatgaggaggagaggctgtaggtggtggtaggaccaccatgttgcatgacttttctgtgtgccccgtcttttgactctgtctc

SEQ ID NO: 333385 - DNA, 2879 bp, Homo sapiens
tgcgtttctgcgtttccgcctttccttttgtttgtctcacgttttgcgtgggaggcggtcccgggatttcaggggtctaccggctctcttatggcgaatgcaacccgaagagagagtgagctgtatcttcagagttgtctccgtctttccaagaacagaacaaaatgaacaaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccagaagtctggacagctgatcacctgaaagagaggagccaagaaaatcaatctaaacatttgtgggaagttgtattcatcaataatgaaatgctgactaaggaacaaggtaatgtaataggaataccatttaacatggacgtaagttcttttccttccagaaaaatgttctgtcagtatgactcatgtggaatgagtttcaacactgtttcagaattggttatcagtaagataaactatttaggaaaaaagtctgacgaatttaatgcatgtgggaaattgttactcaatattaagcatgatgaaactcatactcgagagaaaaatgaagttttgaaaaataggaacactctgagtcatcgtgagaacactttgcagcatgagaagattcaaactttagaccacaattttgaatacagtatatgtcaggaaaccctccttgaaaaggcagtattcaatacacggaagagagagaatgcagaagagaataactgtgactataatgaatttgggagaactttctgtgatagttcatccctcttgttccatcagatacctccatcaaaggacagtcactatgaatttagtgattgtgagaagttcttatgtgtgaagtccaccctttctaaacatgatggggtacctgtgaaacactatgattgtggtgaaagtgggaataatttcaggaggaaattgtgtctgtcacagcttcagaaaggtgataaaggagagaaacactttgaatgtaatgaatgtgggaaagctttctgggagaagtcacatctcactcgacatcagagggtgcacacaggagagaaacactttcaatgtaatcaatgtggaaaaactttctgggagaagtcaaacctcactaaacatcagagatcacacacaggggagaaaccttttgaatgcaatgaatgtgggaaagcctttagccataagtcagccctcacattacaccagagaacacatacaggggagaaaccctatcagtgtaatgcatgtgggaaaactttttaccagaaatctgacctcactaaacatcagagaacacacacagggcagaaaccctatgaatgttatgaatgtggaaaatccttctgtatgaattcacaccttacagtacaccagagaactcacacaggtgagaaaccttttgaatgtcttgagtgtgggaaatccttttgtcaaaagtcacatcttacacagcatcagagaactcacataggagataaaccttatgaatgtaatgcatgtgggaaaactttctaccacaagtcagtactcaccaggcatcagataattcatacagggttgaaaccttatgaatgttatgaatgtgggaaaaccttctgcttgaagtcagacctcacaatacatcagagaacgcacacaggggagaaaccctttgcatgtcctgaatgtgggaaattctttagccataagtcaaccctctctcaacattatagaacacacacgggggagaaaccctatgaatgtcatgaatgtggaaaaatcttttacaataaatcatacctaacaaaacataatagaacacatacaggggagaaaccctatgaatgtaatgaatgtggaaaaaccttctgccagaagtcacaactcactcagcatcagagaattcacataggggagaaaccctatgaatgtaatgagtgtggaaaagctttctgccataagtcagctctaattgtacatcagagaacccatacacaagaaaagccttataaatgtaacgaatgtggaaaatctttctgtgtgaagtcaggacttattttacatgagagaaagcacacgggggagaaaccctatgaatgcaatgaatgtgggaaatccttcagtcacaaatcatcactcacagtacatcacagggctcacacaggagagaaatcttgtcagtgtaatgaatgtggaaaaatcttttaccgtaaatcagaccttgctaaacatcagagatcacatacaggggaaaagccctatgaatgtaacacatgcaggaaaaccttctctcaaaagtcaaatctcattgtacatcagagaacacacataggagaaaaaccttatgaatgaattggatattagaaatttccagccacaagtcagcctccataatgcctcagagtcttcacactgtggagaagggcctgttgacatcctgaatgttcaataactatccacaaactcgccttatgttactccaaagtaacagtaggggataaacccatagactacaacaactataggatggcttttgttaggaagtgatattctgttgaatatcagatggttaatactggcataaaacctcacagatttttttgaatttgtgaaagtttttggcaaaactacaaataggattatgttagcgtttacactgaggagaaaattgtcaatttaagaaatctaaagtgaaaattttgcttagaaataaaatatgacaagttctgt

SEQ ID NO: 333386 - DNA, 2956 bp, Homo sapiens
tgcgtttctgcgtttccgcctttccttttgtttgtctcacgttttgcgtgggaggcggtcccgggatttcaggggtctaccggctctcttatggcgaatgcaacccgaagagagagtgagctgtatcttcagagttgtctccgtctttccaagaacagaacaaaatgaacaaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccaggctcctcttggctatggtggtttcccagactttccttgttttggatgaccttgacagtttggaggaatcctggtgagaagtctggacagctgatcacctgaaagagaggagccaagaaaatcaatctaaacatttgtgggaagttgtattcatcaataatgaaatgctgactaaggaacaaggtaatgtaataggaataccatttaacatggacgtaagttcttttccttccagaaaaatgttctgtcagtatgactcatgtggaatgagtttcaacactgtttcagaattggttatcagtaagataaactatttaggaaaaaagtctgacgaatttaatgcatgtgggaaattgttactcaatattaagcatgatgaaactcatactcgagagaaaaatgaagttttgaaaaataggaacactctgagtcatcgtgagaacactttgcagcatgagaagattcaaactttagaccacaattttgaatacagtatatgtcaggaaaccctccttgaaaaggcagtattcaatacacggaagagagagaatgcagaagagaataactgtgactataatgaatttgggagaactttctgtgatagttcatccctcttgttccatcagatacctccatcaaaggacagtcactatgaatttagtgattgtgagaagttcttatgtgtgaagtccaccctttctaaacatgatggggtacctgtgaaacactatgattgtggtgaaagtgggaataatttcaggaggaaattgtgtctgtcacagcttcagaaaggtgataaaggagagaaacactttgaatgtaatgaatgtgggaaagctttctgggagaagtcacatctcactcgacatcagagggtgcacacaggagagaaacactttcaatgtaatcaatgtggaaaaactttctgggagaagtcaaacctcactaaacatcagagatcacacacaggggagaaaccttttgaatgcaatgaatgtgggaaagcctttagccataagtcagccctcacattacaccagagaacacatacaggggagaaaccctatcagtgtaatgcatgtgggaaaactttttaccagaaatctgacctcactaaacatcagagaacacacacagggcagaaaccctatgaatgttatgaatgtggaaaatccttctgtatgaattcacaccttacagtacaccagagaactcacacaggtgagaaaccttttgaatgtcttgagtgtgggaaatccttttgtcaaaagtcacatcttacacagcatcagagaactcacataggagataaaccttatgaatgtaatgcatgtgggaaaactttctaccacaagtcagtactcaccaggcatcagataattcatacagggttgaaaccttatgaatgttatgaatgtgggaaaaccttctgcttgaagtcagacctcacaatacatcagagaacgcacacaggggagaaaccctttgcatgtcctgaatgtgggaaattctttagccataagtcaaccctctctcaacattatagaacacacacgggggagaaaccctatgaatgtcatgaatgtggaaaaatcttttacaataaatcatacctaacaaaacataatagaacacatacaggggagaaaccctatgaatgtaatgaatgtggaaaaaccttctgccagaagtcacaactcactcagcatcagagaattcacataggggagaaaccctatgaatgtaatgagtgtggaaaagctttctgccataagtcagctctaattgtacatcagagaacccatacacaagaaaagccttataaatgtaacgaatgtggaaaatctttctgtgtgaagtcaggacttattttacatgagagaaagcacacgggggagaaaccctatgaatgcaatgaatgtgggaaatccttcagtcacaaatcatcactcacagtacatcacagggctcacacaggagagaaatcttgtcagtgtaatgaatgtggaaaaatcttttaccgtaaatcagaccttgctaaacatcagagatcacatacaggggaaaagccctatgaatgtaacacatgcaggaaaaccttctctcaaaagtcaaatctcattgtacatcagagaacacacataggagaaaaaccttatgaatgaattggatattagaaatttccagccacaagtcagcctccataatgcctcagagtcttcacactgtggagaagggcctgttgacatcctgaatgttcaataactatccacaaactcgccttatgttactccaaagtaacagtaggggataaacccatagactacaacaactataggatggcttttgttaggaagtgatattctgttgaatatcagatggttaatactggcataaaacctcacagatttttttgaatttgtgaaagtttttggcaaaactacaaataggattatgttagcgtttacactgaggagaaaattgtcaatttaagaaatctaaagtgaaaattttgcttagaaataaaatatgacaagttctgt

SEQ ID NO: 333387 - DNA, 3079 bp, Homo sapiens
tgcgtttctgcgtttccgcctttccttttgtttgtctcacgttttgcgtgggaggcggtcccgggatttcaggggtctaccggctctcttatggcgaatgcaacccgaagagagagtgagctgtatcttcagagttgtctccgtctttccaagaacagaacaaaatgaacaaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccagaagtctggacagctgatcacctgaaagagaggagccaagaaaatcaatctaaacatttgtgggaagttgtattcatcaataatgaaatgctgactaaggaacaaggtaatgtaataggaataccatttaacatggacgtaagttcttttccttccagaaaaatgttctgtcagtatgactcatgtggaatgagtttcaacactgtttcagaattggttatcagtaagataaactatttaggaaaaaagtctgacgaatttaatgcatgtgggaaattgttactcaatattaagcatgatgaaactcatactcgagagaaaaatgaagttttgaaaaataggaacactctgagtcatcgtgagaacactttgcagcatgagaagattcaaactttagaccacaattttgaatacagtatatgtcaggaaaccctccttgaaaaggcagtattcaatacacggaagagagagaatgcagaagagaataactgtgactataatgaatttgggagaactttctgtgatagttcatccctcttgttccatcagatacctccatcaaaggacagtcactatgaatttagtgattgtgagaagttcttatgtgtgaagtccaccctttctaaacatgatggggtacctgtgaaacactatgattgtggtgaaagtgggaataatttcaggaggaaattgtgtctgtcacagcttcagaaaggtgataaaggagagaaacactttgaatgtaatgaatgtgggaaagctttctgggagaagtcacatctcactcgacatcagagggtgcacacaggagagaaacactttcaatgtaatcaatgtggaaaaactttctgggagaagtcaaacctcactaaacatcagagatcacacacaggggagaaaccttttgaatgcaatgaatgtgggaaagcctttagccataagtcagccctcacattacaccagagaacacatacaggggagaaaccctatcagtgtaatgcatgtgggaaaactttttaccagaaatctgacctcactaaacatcagagaacacacacagggcagaaaccctatgaatgttatgaatgtggaaaatccttctgtatgaattcacaccttacagtacaccagagaactcacacaggtgagaaaccttttgaatgtcttgagtgtgggaaatccttttgtcaaaagtcacatcttacacagcatcagagaactcacataggagataaaccttatgaatgtaatgcatgtgggaaaactttctaccacaagtcagtactcaccaggcatcagataattcatacagggttgaaaccttatgaatgttatgaatgtgggaaaaccttctgcttgaagtcagacctcacaatacatcagagaacgcacacaggggagaaaccctttgcatgtcctgaatgtgggaaattctttagccataagtcaaccctctctcaacattatagaacacacacgggggagaaaccctatgaatgtcatgaatgtggaaaaatcttttacaataaatcatacctaacaaaacataatagaacacatacaggggagaaaccctatgaatgtaatgaatgtggaaaaaccttctgccagaagtcacaactcactcagcatcagagaattcacataggggagaaaccctatgaatgtaatgagtgtggaaaagctttctgccataagtcagctctaattgtacatcagagaacccatacacaagaaaagccttataaatgtaacgaatgtggaaaatctttctgtgtgaagtcaggacttattttacatgagagaaagcacacgggggagaaaccctatgaatgcaatgaatgtgggaaatccttcagtcacaaatcatcactcacagtacatcacagggctcacacaggagagaaatcttgtcagtgtaatgaatgtggaaaaatcttttaccgtaaatcagaccttgctaaacatcagagatcacatacaggggaaaagccctatgaatgtaacacatgcaggaaaaccttctctcaaaagtcaaatctcattgtacatcagagaacacacataggagaaaaaccttatgaatgaattggatattagaaatttccagccacaagtcagcctccataatgcctcagagtcttcacactgtggagaagggcctgttgacatcctgaatgttcaataactatccacaaactcgccttatgttactccaaagtaacagtaggggataaacccatagactacaacaactataggatggcttttgttaggaagtgatattctgttgaatatcagatggttaatactggcataaaacctcacagatttttttgaatttgtgaaagtttttggcaaaactacaaataggattatgttagcgtttacactgaggagaaaattgtcaatttaagaaatctaaagtgaaaattttgcttagaaataaaatatgacaagttctgttttgagtttgatgccataatagtttttaaggtatctaacaataatttatagatgtacattgtggaatgtaaagctttaagaattttttaagaagtaataattaaaataacctcacaagaagttgtaatgagtacagagaattcccgtgtacccttcaccaagcttcctctaaggataatatataatcatagtatatggtc

SEQ ID NO: 333388 - DNA, 1592 bp, Homo sapiens
tgcgtttctgcgtttccgcctttccttttgtttgtctcacgttttgcgtgggaggcggtcccgggatttcaggggtctaccggctctcttatggcgaatgcaacccgaagagagagtgagctgtatcttcagagttgtctccgtctttccaagaacagaacaaaatgaacaaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccagaagtctggacagctgatcacctgaaagagaggagccaagaaaatcaatctaaacatttgtgggaagttgtattcatcaataatgaaatgctgactaaggaacaaggcccctgaggtgttcatgcactgatcctggaccttggattaaacccttgcagtgctggaagaagaggactctgcactgcctgccacaccaggactggaagatcaatggccttcccttcttccaaactaccttcccatgaggtggggatggtggtcacatctccaacactggcgtgctgtggaagagacatcagcattctctgcaacaaatttggaaacagcctaaagagacgtttctacttcaaagagatgcactgaggaagtgcactggcactgctggggactcacctggggcccagggctgaggcttctcgtgtccttggagctgctgtcctcccgaggagcgtccacactgcagccagctcagcctcaggtgtcctatctggttttgaaaccaaatctaagtgggaaaagaagattcaagttttatccgatttagtctacataattttaagtatctatttgagctcaacaccaagaatcacttccttctctgtcccatctgtggtctccaaaggaaaggtccctgggttaggagacactggctagcatcctaaagccagagctggccgatgggtgtgtgtccactcttccttcacctcttccccaccctacagttgtttttgtctcatgctcacttgctctttctgcctccctctcactctttaggtctcacaaaggctttggtcaaggactgactgactttccttggctctctgtcatctccccataatcaaaggcatttcataacacacaatccatgtgaagggacctctgatcaaaattcacttaaagaggagctcactaattaccagtacttactgctgagcctggaatcattcgtatataccccagagttcattcattccagacacagtactagataaggagactcctatgagccaaaaacctaactctgaatagactgtgactgtcataatcaaaccctgtggtcccagctactcagaaggctgaggcaggagaattgcttgaacccggaggcggaagttgcatgagctgagatcctgtcattgcactccagtctgggggacaagagcgagacttcatctcaaa

SEQ ID NO: 333389 - DNA, 385 bp, Homo sapiens
tgtgaaaggcttggtcagaatctcaggtggcaagaaatggagctctcttagccatctgaaaaccatcagtgtttccaagtctcacagcagttgggggattcgaacaacagtcacaggtaagccttaatcttagaggacaaatcaaggggagcccaggagaggagatccctgtctgcctttgttggtcacctatcttgggtaactaattcagctgagaaggaagtagaaaggtctttgtgtccagatgatcagtctccttcactggccctcagcagcactggactgccccagaagccactgggtatgtactttggctagggtgacagggggatactcaccctcagccaaacagcttgaaaccaagagaaggtacctgtaatgacaa

SEQ ID NO: 333390 - DNA, 192 bp, Homo sapiens
ctcttagtgctacagacaggacccggtttggatggagcaggcagctggctttgccatcttaagtcacgcccagtaactctgtttgctggtcatagagtatgtttgcccctacaatgacaaagcgccagtcaaggcaaagcctggggctgggaaacatattcaggcgggatctcctcttttaggctgtggggc

SEQ ID NO: 333391 - DNA, 246 bp, Homo sapiens
accatctgaagactgccatgtccaacatgcctgctgtattccagaggaacttgaaaggagatagagacagaattcgcctctcgccaagacccacgaccgcagggagcacgcacaggcgattcccgtgccccacttgcttcctcccacgccacccagcgtgccgatcacctgcgcccaagaatctgctgcctgcagggtgaccaagacctccggaatgttcctccacacacttctgctctggttgtc

SEQ ID NO: 333392 - DNA, 420 bp, Homo sapiens
tcctccactgtagatgacatttatttgctcatatatctcaccttggtgagtagaattcttagtccaaatccctgaaaggaatagtgtggctccctagtgcaaatttcctgagagccccttccctcagtatgtgccaagaatcaaatcttggccacttagtgctctgtgttccacatgtgagctcgcgacgcgctgaacggctgtgctaactgagatggatggccctgtcaaacaggaagctggcacaccagggtgcaagcagtgggatacaatgacctttacattcagagaaaaatatccctaaagtggcatgaaaagtttgtggggggaagggaagggagattcttttatttcatttaagtacatagcatgacataaaagcaatggtgcccagtatgcaatttgctcaggatcaaatcg

SEQ ID NO: 333393 - DNA, 362 bp, Homo sapiens
atttggtcctaacctcaccaggctgctaaaatgacacactgtgactgctgggctccctcttgctccgtccctctttgatgcctgtttgttccttgaatgatgaaatgacccagcaacatactgtccctaacccatggatggctgtcactgacatttgtctcttctcattatcattagtgtctgggaggcaaaacacttgtttagaagctgtatctgccttattattacttactttgaaggagcaggtaaaaagtcattagggagctcactctcagagatccaggaatggtccctgccttttaaggtatgctgtttggaccaggtggctgacagtctcactcatcttctttttctgaccccac

SEQ ID NO: 333394 - DNA, 699 bp, Homo sapiens
cacactgcaacaggtttggagtggtgctttgaaagagcagcaaatggcctggctgctgctctcttgttcctccctgaagcctgagctctgcccagctagtgaatgacaaagggggcgctttcagcctctgtaaatagcctattgtacaaggggaggaggcggggcacggaatggcagcatcttgccagcttgggttgctgcgttaaggaaagatgtcaggctttcttaatttgccactgcaggggcaagggtgtcatttatgtgggtttgtttgagggctgcattcctagtgaagtattccatcaaactgccattattcatcttgatgaaagcttgaggaactttagaaggagagaaacatccagaccacccggtttttggtttctaaatgacatgaagagaatactatgttaatgtaagtaaaagtttgcagagttgcaggggcagtgtgtgtgtgtgtgtgtgtatgtttgtgtatgtgtatcttcaagagaatgatgtccttgtgagtcacctctggccctgagccactattttcatggtacaaataaaatggtgaagaggtgaacctttgtgtatagtgggccttgaactcaccacgtgttcagaggccagggtgatacaataaatgctaacgtttttgtaagacattgagcatttaggtggacctcaggagggagctgtcataatacctgggag

SEQ ID NO: 333395 - DNA, 388 bp, Homo sapiens
ggagagcctgactgctcttttggttcaaaagggaatggcttaagcaaatctaactttagggaatttgccaagccagggttaaggagcacactgcaacaggtttggagtggtgctttgaaagagcagcaaatggcctggctgctgctctcttgttcctccctgaagcctgagctctgcccagctagtgaatgacaaagggggcgctttcagcctctgtaaatagcctattgtacaaggggaggaggcggggcacggaatggcagcatcttgccagcttgggttgctgcgttaaggaaagatgtcaggctttcttaatttgccactgcaggggcaagggtgtcatttatgtgggtttgtttgagggctgcattcctagtgaagtattcca

SEQ ID NO: 333396 - DNA, 5861 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333397 - DNA, 7657 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggtctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333398 - DNA, 7938 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaagaaaaaaaaaaaaaaaaaaaaaaaaaaaaaaaaaaaaaaaaaaaaaaaaaaaaaaaaaaaaaacataaaggggggccccaaaacccaatttccccttaaagggagccaattacaatttaatggcccgtctttaaaaaacgtcgtgctgggaaaacccttgggttccccaaattaattcccttggaagaaaattccccttttctcagttgggggaaatcccaaaaggccccgtccaaatggttttccca

SEQ ID NO: 333399 - DNA, 7101 bp, Homo sapiens
agtggtagacactgagggaaagagctgtgattaggagggtatgagctacaactacacgagaccgatgtcattgcgtgtacattggattctaaagatgatagtaggtgaatattaaacataatttagcattaccatgatattgttagatatcgtattaaagttagtatgtaatctcctatgataactattttgaaaaaggactactatctcttcagtatataagtttattaaaaactattactttagaagaaggaaaggataaagaaaaaaccttcagtgcttatttctgtctacttacataattgtattattcacttatatagtcaatagtttactcctctgttttctgaataaagtgcatttttaaaatttgtctcttcagcgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333400 - DNA, 6033 bp, Homo sapiens
gagtcatccacgtcttctcccctacacgagagtaaacccctcttcttcattgctactctggagtaggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333401 - DNA, 7603 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333402 - DNA, 7483 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatga

SEQ ID NO: 333403 - DNA, 7159 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaaggtaagaaagctgcaattgtggaggtagaatgcagcagaagaaagacagctaaaatatggagacctgagttcaagttcccatgctaccatttatggctgtgggaacatcatacatattgatcaactttcaaatatatcatcagtaaaactagaataaaacctatttacctcacaggattaatctaagaat

SEQ ID NO: 333404 - DNA, 5254 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagagaaaaaaaaaaaaaaaaaaagccatatgccctgcactttgtcccaccttttacctctgcccttctcactccagtggatgcttttcctctgagacagtacgtagtatcaaataaatagtcctttagctttctgctactagatctataaatctacctgcatctataggtatctcttctttatgaaaaattacttcttacatatgtactctagattattctgtctactttgagtcttcaacctcttcatctgtgaaaagcgttttcagttaaaatacataaaatgtcattgcagatcagcatttatagatgaacagttgctctcagttttaatgatagggaacactaactttgaaccccaattaaatgaactgttatctccctccaaaataattatattcttagtggtaaacttataaaagattatatctaattattagtattagcatatttaacatttcttcaataaaatttttttgtggaaatttgctttctctcattatgtaagtacgtatattacatcttcaattttgtcacagcacctaaaagatttactacttgactctttacagaataagtttgttggcctcaggtgtaggccgccctaactggggcggaaggatagagaaaagtggattcaagagatattcagcaatagaatggatacaacttggtcattaattaaaagtgatgggtgagagagaacaagttcaggatgcttcttaggtttctgtcttaagcatcttgggtgaattaagacctttatgttgtcctggcaaaaactaggatgatgattttaattagctacattgatttatcagtagtaatgaagaattgtatctcttgtctttaaaaaaaa

SEQ ID NO: 333405 - DNA, 2466 bp, Homo sapiens
gtcttgacttcctgggctgaagcttttctttcacctcaacctcccagagtgttgggattatagacggtgcagtttgtttttaactcagtttaacccagttctgtgggttaaaaaaaatgatgtggcagaatgtttaatatacttctgcatggagtaagactctgaagttttgttttcaatcatgttgttttttagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333406 - DNA, 2107 bp, Homo sapiens
cacgagggaatgtacatcttctatactccctcaaaatatatctacgaattatagtctcccaggttctgtatactgtagtaggtcaggaagatctctttcttttgtcatcaagtctggcctaaaataaaaacttggaacttttgagacagaacgaacttccagtttccatcactgctatttactattaaatttagtcaagacacttatcttctctaagcctcaatttctttttaaaactggagataataaatatcaacctctaaggattgttaaaggtttaagatttggtattttaaaaaatttaatataatattgttttacaaaactactggaaaaccgagttcctgccaaatgagcaggtgtgccataaatgtttgttcccttgccttcagcatagtttgttctgtgactcacttaatttacaagtccctagccccacattattggtatcagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333407 - DNA, 2161 bp, Homo sapiens
cacgagggaatgtacatcttctatactccctcaaaatatatctacgaattatagtctcccaggttctgtatactgtagtaggtcaggaagatctctttcttttgtcatcaagtctggcctaaaataaaaacttggaacttttgagacagaacgaacttccagtttccatcactgctatttactattaaatttagtcaagacacttatcttctctaagcctcaatttctttttaaaactggagataataaatatcaacctctaaggattgttaaaggtttaagatttggtattttaaaaaatttaatataatattgttttacaaaactactggaaaaccgagttcctgccaaatgagcaggtgtgccataaatgtttgttcccttgccttcaaaaagacgcatgaaatgatgggcatgttagtccttttgttattgtgagagtcctgcatagtttgttctgtgactcacttaatttacaagtccctagccccacattattggtatcagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333408 - DNA, 384 bp, Homo sapiens
ccacctcagcctcccagaatactaggattacagatatgagccactgcacccaaccagaaagtatttctcaaataaatatgttgtctcctttagaaaagcagaataacatttgttcttgcttctaggatcagtgttattttttttcttgatctgctagtttgacaaatagcttttaaaattaagtagctcagttgctgcaagtccttcgttaatatacttaaggtttaaaagtccaagtttataaaattgcagagatatttgagattcttttacataagaagggagtttatttattgtcatttctctgctactttccttatctgttgattttctttgtgatgccttctcttagcagcccagctggtccgcaaccttgtaaatgct

SEQ ID NO: 333409 - DNA, 320 bp, Homo sapiens
tttttggaagaagtattttagtatgtcttataggtaaattctaaaatggtattagagtatttggacctttgggttggatcacttgaaatctaataatacaattaatttttttatgcagatctttgatggaaaacagattccacagagaatggttgatggatggaatgctttcttctttgataaaacagaagaactggtaattttaaaatagtctttatgttctagaatgctcactgatatatgttagcatctgtataatttaataattttacttaaatttgctgtccatgttttggatagtactgtatagacattgttct

SEQ ID NO: 333410 - DNA, 426 bp, Homo sapiens
ttcacacagctagtaattgttggagccgggattcgtaacccaggtctgtctgactccagagttcatgctctttccattgtatctcactgcctctctgtaatttttttaacccataatgtagctgaaatatagtactaatagtactgtagaacctaaccactgctttctgaaactgatagctttctgagttccaccgtgagatgccaggagcagaccttccccaagtgcaatttcagcagtaagagtgggtacttacgctttccttttttgtataccaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgt

SEQ ID NO: 333411 - DNA, 442 bp, Homo sapiens
agcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaaggtaggatacagtttgtaaatgatctgtaagattttgtggttgttgtatgactatgtatattttttagattagaaatgtaaaaatagctatataaagtggtgacttgttttggaatgatattttggta

SEQ ID NO: 333412 - DNA, 305 bp, Homo sapiens
  misc_feature (249)..(249): n is a, c, g, or t
gctcggtacccattggtggtgcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtaaaagactaaagaagaaagacagtgaagaagagaaagatgggaatgaagaagagaaagantcccgagatgttcttgacccccgagacctccacgatactcgagactttagagaccc

SEQ ID NO: 333413 - DNA, 7692 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333414 - DNA, 7921 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaagaaaaaaaaaaaaaaaaaaaaaaaaaaaaaaaaaaaaaaaaaaaaaaaaaaaaaaaaaaaaaacaaaaggggggacaaaaaaccctatatagtaatatagagagtcattttacaatcttttggcctacttttataaaacggcgaacgtgggaaaacccggggtattccccaattaatcccttctttaaatatccctttttcccccggtgggctatttttatttggtaaact

SEQ ID NO: 333415 - DNA, 7578 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333416 - DNA, 7572 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatga

SEQ ID NO: 333417 - DNA, 7415 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaaggatggagtcttgctctgtcgcccaggctggaatacagcggcgtgatctcggctcactacaatctccgcctcctggttcaagggattctcctgcctcagcctcctgagtagctgggattacaggtaagaaagctgcaattgtggaggtagaatgcagcagaagaaagacagctaaaatatggagacctgagttcaagttcccatgctaccatttatggctgtgggaacatcatacatattgatcaactttcaaatatatcatcagtaaaactagaataaaacctatttacctcacaggattaatctaagaat

SEQ ID NO: 333418 - DNA, 2898 bp, Homo sapiens
  misc_feature (3)..(7): n is a, c, g, or t
  misc_feature (41)..(41): n is a, c, g, or t
ttnnnnnagactaacggtgggcaatccccctcttctggggnaccagcataccgctttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaaga

SEQ ID NO: 333419 - DNA, 5693 bp, Homo sapiens
tcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagaggccttaatagtgggaaggagattgtccaagctccagggaagaaaaagactgattggacagggaagaagtgtcccaggccttctcaacagcaactagcaaaggagggtatccttgtagatgttcagtcctttaccagcctagctattgttatttatgtttcaaaatgcgggactgtttgcaagattggggtgaggcccagcttctggcatctgtagtggtgtcagtatcgcctctgttacattataaaagaattcagcagaatagtgtgcttttctaaaatcattcttttgaacggtggttttgaaattgttagacccggagtaaagatggcagtgatgacttaacttctggccataagaagttgcttctggtgtcttaacatcttgttttataaagaaactgaaaagttgcaagtattttatttgttctcctttacttaaattctgcttagagccacctacttggaaagtggctgcccttctccattctgaagagtaagaattgagggaataggaaatgatttttatacccaggaaagaggttagagttttagatatcttctatgtaaaatttattaaacttctaatcactaagggtttgtatattatatataatctgtgccattcctactgggaagttgaaacaatgaaaataataaatcattttctttcagatgagccataattgaaacttttaagattagcataattgtatcgttgaataataaagagaaaaattacctcctttgttaattttatcatatgtgaattagtaactaatggtttctttgaaatcctttggtttagctgcaatggctcctgctctcatgtagctaaaaagaacatgttggaaaaatgcaaatgactttataactcttgggattgatgtttatacccttcagctatttccagttaatttttaatgccataatcattatgtattatgattatcattaccataccaactctgctgtctctggtttttacaagagtaacacatttaaatttacagaggtaagaatttccttggagaaataggtgctggtgataataggagtatctttcttttccatatcaacataattataataaataactcacagatttaaaggcttattttgtgccaggcattctgctgagtgctttacatacatgtctcatgtaatcctcccaacagctctgcaggacaggagtttatgattatcttgattttatagaatagtaatgtaatgctcagagaggttaaacatctggttagtcacacagctaatcaatacttagtttaagatttgagactgggtgcagtggctcacgcctgtaatcccagcactttgggaggctgaggcgggcggatcacgaggtcaggagatcgagaccatcctggtgaacacggtgaaacctggtctctactaaaaatacaaaaaaattagccgggcacggtggcgggtgcctgtagtcccagcaactcgggaggctgagacaggagaatggcatgaacccgggaggcagagcttgcagtgagccgagatagcaccactgcactccggcctgggcgaaagagcaagactccgtctcaaaaaaagaaaaaaaaaaaaaaaaaaaaagatttgaatccaggtttgtctcaatttggagcctatgtacttaatcagtatattgttttgccctcaccaaactcacctctagttgtttattcacttattgaaaaccatattcttctcctgtctttgtgcttctcaaactttaatctgcatgtgaattaccttgggatcctgttaaaatgcagattatgatttagtagactggggagggtcctcagattctgcatttctatcaagtttccagattatgctgatactgtaggtctatgaatcacttacttggagtagcaaggttattatagagctttatggctggaaattgtaaatgctactattaaatgcttagattaaagtagaatttgcacaaggtgaaattgagtcaaacttatttatttgatttgttttttagaaattaaattgtaaggaaataattgaaaatttggcaaaaattcttaagagacatccaggtatgaattttgaatcttatctgtaaaacaaaataaatttttttagcatatatgaaaattatttaacctactgaagtcttttttttttaaattaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaaggtatttatgaaaaaattaatgatctgctttgttcatgataattaaaatgaaacataactaatgtcagatttgtgaaaaattttgtctcagttttgtttatctgagcttttaaaaaagaaactttcagtattatatagcttgaatagatacctatcagagtagggtggctctgtcttt

SEQ ID NO: 333420 - DNA, 658 bp, Homo sapiens
gcctacgggcacaagtgcacaaaagtcatcccaaaaaggtgccaatctggtggaaacccaggacacttggaaaacgcgattaccatcagtgaccaggaggaccaccgttatgaaggaaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333421 - DNA, 627 bp, Homo sapiens
  misc_feature (2)..(2): n is a, c, g, or t
  misc_feature (6)..(6): n is a, c, g, or t
  misc_feature (8)..(8): n is a, c, g, or t
  misc_feature (509)..(509): n is a, c, g, or t
  misc_feature (521)..(521): n is a, c, g, or t
  misc_feature (529)..(529): n is a, c, g, or t
  misc_feature (555)..(555): n is a, c, g, or t
  misc_feature (617)..(617): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaactttcagacagcaaagttctcttgtacttgttgtcagcctgttgttgtgtagtgtttgcccgtaaggaaacttggnaattctagagcnagcccacngtagttcccccttgtattgtatttcnattcccagccacttgccaccagtaccccttgtgtagcttgcttcttgttctacctttgtacnaaccaccaat

SEQ ID NO: 333422 - DNA, 843 bp, Homo sapiens
ataacgatgcagccaacatgctcagcctttgtgcatgaaatcctaggcgagcagagaaacgagctggggatcttcttgcaggctcacaactgggccccaccctcttttaggcagggggaggttttagccctaacaccagccccagagggccttgctgaggccttcatggtcagctcgctggcttggggtggtctgattaaatgccaggcgaaggccgtgtgggcctcgagacggagggagggaagagggcgtgcactggagacagcatctgaccaagtgaatgtgtttgtccctttgttattccggaaccgctcaggtggacctgacttgttttgtcgctttctttggggaaagccagatgtttgagttgttttgtattgttttccttcaagttcgagttgattatctctaatcacatacttgcaagcaaacgctctttaatagaggcctattaatatgctttctattttttgctgtgctcagttttatagatttccccaagtaaggttcatttttgccatttaaggaaaggaaacaaagacagagcttcctaattatcctcagtaattattttcaataatatccttgagtatacgatatcctctcgcgttttctgaacagacttcacattcttcttcttttcttcttcctttggaaaacatcgtgacactcccagctggccagctcagcgtccctggaagggaagggacaactgaagttcacctcaggacggtggagcccacatcataactgcacccaggtggccacagcgaacgacaccaccctccgtggctgggacacccggagcatgaggtcagtgagcccacccggcgcaggccccac

SEQ ID NO: 333423 - DNA, 1783 bp, Homo sapiens
  misc_feature (2)..(2): n is a, c, g, or t
  misc_feature (6)..(6): n is a, c, g, or t
  misc_feature (8)..(8): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacattttgttgtgtgctgtctctggattcctttggtgctcttgggaagtcagctgcccaactgttcatagcactggcaacctcttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333424 - DNA, 1545 bp, Homo sapiens
  misc_feature (2)..(2): n is a, c, g, or t
  misc_feature (6)..(6): n is a, c, g, or t
  misc_feature (8)..(8): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaatgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333425 - DNA, 1485 bp, Homo sapiens
  misc_feature (2)..(2): n is a, c, g, or t
  misc_feature (6)..(6): n is a, c, g, or t
  misc_feature (8)..(8): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccagcttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333426 - DNA, 1266 bp, Homo sapiens
ggctgtacggctccgcggaagtacggatcctgattccaattccttcggcatcctccacacggctgcacatgtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333427 - DNA, 1477 bp, Homo sapiens
ggataacagggttggccacagccggcctgcctccttccccttcacatcctgtcccgaacatgacttctgacctggaagttatcactcactttggtggactcatttatttacacgcccaccttttcctctagaatttgagttcctgaaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaatgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333428 - DNA, 1278 bp, Homo sapiens
caaggccttagcccctggccaccccgaatctgtactctatctctgtatgttatttggagaaggttctataaatggaatcacacacagtgtaacctttaataactgatgttctttactcggcttgattccctggaggttgagttgctgcttcattttcaagtttgggttccagccaccatgcgtgctggtcagtggctggttcctctttgctgcggcgggatattccatggcatgacgcaccacggaaaacatcgtgacactcccagctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333429 - DNA, 1249 bp, Homo sapiens
  misc_feature (2)..(2): n is a, c, g, or t
  misc_feature (6)..(6): n is a, c, g, or t
  misc_feature (8)..(8): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333430 - DNA, 1193 bp, Homo sapiens
ctctggcatgctttcattctcaagatgataccaagtcacatttttgacggctacaaagcaaaaattccttccacggctcgcccagagggtcacagatacgcttctggagagatgagcgtggtgcgaccacacagggttgctgggatggaggaggtggcgccagcctcttcctgcagggcaggaacgccgaggggatgagagcaccctgggccgggggattagacagggtcccgggaaaccagtgtgtgcccgcagcacgcagtggcttttcctaatccatttactattttcctttgctgttcttccttctccctcagcccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333431 - DNA, 486 bp, Homo sapiens
tgcgtcatgaagaacatgtatcacagctcttacctaccagcctgggtatctcaaatgtttatgttaacatttggtacttctctttctcttagtgtcgtgtgggagccaatgggagatgggaagaaaatcatttccttggctgataaccatatcctgctgtgggatttacaggaaagctcgagccaggctgtggtaagtaaaagcaacaacacagcgtttgtttctgtatttttaaaccaaaccccgcatgttctcactcataggtgggaattgaacaatgagatcacttggacacagggtggggaacatcacacaccagggcctgtcgtggggttgggggagcgggagggatagcattaggagacatacctaatgtaaatgactagttaatgggtgcagcacaccaacacggcacatgtatacatatgtaacaaatctgcacattgtgcacatgtaccctagaacttaaagtgtaatgaaaaaaat

SEQ ID NO: 333432 - DNA, 486 bp, Homo sapiens
ttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgcacaggtgctcggctcattctttcaggagctctgccctgtgacccca

SEQ ID NO: 333433 - DNA, 1702 bp, Homo sapiens
  misc_feature (2)..(2): n is a, c, g, or t
  misc_feature (6)..(6): n is a, c, g, or t
  misc_feature (8)..(8): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333434 - DNA, 942 bp, Homo sapiens
  misc_feature (2)..(2): n is a, c, g, or t
  misc_feature (6)..(6): n is a, c, g, or t
  misc_feature (8)..(8): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgagggaagaatctgaacattctgaaggagcgtgcacggaccctgtgtgtgccatcattcccaggctggaggccttgtggggaagaggaacactggagtcggggaacagggatggccccagacacctgcacctgccacgggcctcactcacagaaggaggacctgccacgagcctcactcaaggaagaaggactcgccacgggcctcactcacagaaggacccgccacgagcctcacgcatggaagaaggaccc

SEQ ID NO: 333435 - DNA, 1724 bp, Homo sapiens
  misc_feature (2)..(2): n is a, c, g, or t
  misc_feature (6)..(6): n is a, c, g, or t
  misc_feature (8)..(8): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtggaaaacatcgtgacactcccagctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333436 - DNA, 1639 bp, Homo sapiens
  misc_feature (2)..(2): n is a, c, g, or t
  misc_feature (6)..(6): n is a, c, g, or t
  misc_feature (8)..(8): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataaccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333437 - DNA, 1565 bp, Homo sapiens
  misc_feature (2)..(2): n is a, c, g, or t
  misc_feature (6)..(6): n is a, c, g, or t
  misc_feature (8)..(8): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaagtaagtgcggcttttctaagtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333438 - DNA, 1429 bp, Homo sapiens
caaggccttagcccctggccaccccgaatctgtactctatctctgtatgttatttggagaaggttctataaatggaatcacacacagtgtaacctttaataactgatgttctttactcggcttgattccctggaggttgagttgctgcttcattttcaagtttgggttccagccaccatgcgtgctggtcagtggctggttcctctttgctgcggcgggatattccatggcatgacgcaccacggtttgttaagcacttgcctgttgaagctcatctgggtttttccttgtttttggcgattatgactacagttgcgtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333439 - DNA, 1319 bp, Homo sapiens
ctggggaggggggcacaattcagtccataacagtgagacaacaacagtgttgtcaggcattgccgggtgacagtgtaaaaaatactctagtgactacaggccggaaaagatttcctgcgtcatgaagaacatgtatcacagctcttacctaccagcctgggtatctcaaatgtttatgttaacatttggtacttctctttctcttagtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333440 - DNA, 1688 bp, Homo sapiens
ataacgatgcagccaacatgctcagcctttgtgcatgaaatcctaggcgagcagagaaacgagctggggatcttcttgcaggctcacaactgggccccaccctcttttaggcagggggaggttttagccctaacaccagccccagagggccttgctgaggccttcatggtcagctcgctggcttggggtggtctgattaaatgccaggcgaaggccgtgtgggcctcgagacggagggagggaagagggcgtgcactggagacagcatctgaccaagtgaatgtgtttgtccctttgttattccggaaccgctcaggtggacctgacttgttttgtcgctttctttggggaaagccagatgtttgagttgttttgtattgttttccttcaagttcgagttgattatctctaatcacatacttgcaagcaaacgctctttaatagaggcctattaatatgctttctattttttgctgtgctcagttttatagatttccccaagtaaggttcatttttgccatttaaggaaaggaaacaaagacagagcttcctaattatcctcagtaattattttcaataatatccttgagtatacgatatcctctcgcgttttctgaacagacttcacattcttcttcttttcttcttcctttggaaaacatcgtgacactcccagctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcagtagtaactcttctttctcttgagagtaaaaaatgaaataaaataaatccacgctgca

SEQ ID NO: 333441 - DNA, 1020 bp, Homo sapiens
  misc_feature (2)..(2): n is a, c, g, or t
  misc_feature (6)..(6): n is a, c, g, or t
  misc_feature (8)..(8): n is a, c, g, or t
tnggangnggcactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactggtagggccgctcctggctgcttcag

SEQ ID NO: 333442 - DNA, 433 bp, Homo sapiens
cctcctgagtagctggaattacaggcacgcaccaccatgcctggcttaatttttctttttttcgtagagacggggtttcaccatgttggccaggctggtctcaaactcctgacctcaggtgatctacccacctcggcctcccaaagtgctgggattacaggagtgtgccactgcgtctggcctaccaaacgaaattcttactcttaatctagaatgagaactattgagagttcatccattagaacccttgaagcctgtccctcagatggttgaaagtctgtagctggaggacggttgaaataaacagaatattgatatgaaatatttctgaaggtatcctttttccatatcctatatttaacttagctggcatattagagttgtccagagaaacagaaccaataggatgtgtatatatacagagaaaaatgta

SEQ ID NO: 333443 - DNA, 403 bp, Homo sapiens
tgatttgaacatacccacatttaacaacagctattcttctggaagactcaaactcttgggttagatttttttaaaaaacatggctttgtgaagaacagaaagaagagatagagaacatgtatttctttataaaattaaactcagccaagtgagaaaagccctatctctataagaaaaaaaaatctaggaaaacatggttactgtcctcccaaagaaaaaataattgcatgaatgtttcaagcaaagcattcaatatatttccaaaccatcttaacatctctctctgtattgccattgctcaagggatatcttctatggttttcccacaggtccatatgcaaaaggtaaatccattgccctgacaccgaagctaaatacacatggtagctgaggttacttggat

SEQ ID NO: 333444 - DNA, 261 bp, Homo sapiens
cttacagggatttaatctttctttgattcactggctataggctgatgcagttctccttcctctctacttttctttttcctttgtgttcctctccccgccagcaccaacatagccaatatagccaatctttgactcccttcttcttttctagttcagataaatgactcactttgtggcttctctcacctttagacccagattcacctttctagcctcatgtcctacctgagcctcaccttcctgtgggatccttcttcggga

SEQ ID NO: 333445 - DNA, 396 bp, Homo sapiens
ctgcctcagcctcctgagtagctgagactacagacacatgtcgccacatctggtcaacttttgattcttcaaagaagctagtaaggaaacattatcatttatgtatcatgtaatatgctaagtgttttaaattatttatgtatttcactcatttctcacaacagctctgtgagttagggattaaacccccccctttttttttcagacagattctcactctgttgccaggctggagtgcagtgtcgcgatcttggctcactgcagcctccacctcctgggttgaagtgattctcctgcctcagcctcccgagtagctgggactacaagcgtgcaccaccatgcccagctaatttttttatttttagtagagacagggttttaccacattggccaaga

SEQ ID NO: 333446 - DNA, 860 bp, Homo sapiens
gagttgtgggtcttcctttgcaacgtttcttcttcgctgtgcctctggtcgccatcacaaactgcattaggaaatgagagcgagcatgtggcctggcttcttgatggagatcgtcctcgctcttttcataaagggtcctagatgaacaccgattccctcctgtggtgattggctatggcagccagtgtcccgtgtcctctccatatgaggagtgagggcctgcagatccctccattggccagcctggttctgggagagagatactgaactcagcttggccctggtcccatttcttccagtacccgctggtggtctctgccctcaccagagctggaaggacttgatgtggtttgaccacatcactgtaggattttctcccagatggggatgaccagctgcatcactccccagagtccttccggagaaataaaagcataggcatggcggctaagggaagaaggcataagaaggcagattgaggattgttaagaagactccgcccttgcccccagctctgcctaccatagtattgctcccttttggtcactgatgcacatgactaagaagagttctctcctgagtaactacatgactttggagatctttgtcattctcttcactgcttatcttccagaactcatgattacccacacatgcctttttaccaggcagtaagaaatgcagcccccctaggtagtagcatggtcccctccttggcccactccactcttgccctcaacctctttcaaccaaacattatcacccaccttaagaaattaaaaaataattctgtcccagtctgtctgaacttagtacatgatccaggatgtgatgggatcttagggcttggctggaaggtt

SEQ ID NO: 333447 - DNA, 225 bp, Homo sapiens
tccatctctactaaaaatataaaaattagctgggcctggtggcatgcgcctgtaatcccagctactcaggagtctgagatgggagaagcacttgaacccaggagccaagattgcaccactgcactccagcctgggtgagagagggagactccatctcaaaaacaaaaacactgtattgcctaaagtcagaagaatgaattaaatgagctcttatgagccaaacta

SEQ ID NO: 333448 - DNA, 220 bp, Homo sapiens
aaaagaaaagaaagaaaacgtttcctgatactcaaagccagatgacatgtctctgctatgccacatattctaacctgggagccaagcagagcaagaacccccctttcacagatctaccctgcaaacatttgggggcagtgttcatgccttttggaacgttgcctgttttgccactcccagcttctctcctttccctgacctattgaaccagcaagaccca

SEQ ID NO: 333449 - DNA, 468 bp, Homo sapiens
catattggaaggctgcgatgtgcggatcacctgaggtcaggagttcgaaaacagcctggccagcatagtgaaaccctgcctctacttaaaatacaaaattagccaggcatggtggtgcctgactataattccagctattcggcagagtgaggcaggagaaccgcttgaacctgagaggcggaggttgcagtgagcagagatcacaccactgtactctagcctgggcaacaacaagagcaaaactctatcttaaaataaaaataaataaataaataaataaataaaaactttataccctttaagcattttctgattaaaaattcttttaaacacttaaaaaaaaatttaggccaggtgcagtggctcacacctgtaatcccagcactttgagaggctgaggtgggtgggtcacctgaggccaggagttcgagaccagcctggccaacatggtgaaactgtttctacttt

SEQ ID NO: 333450 - DNA, 234 bp, Homo sapiens
ttcttgcaaatgaagagacaatatgcccaaaaaatgagctgaaaatggctcatgaagggagggaagatgacctccagcacaccagggcagagtgggggccacatgaaggtgcaagagtgggagggaaccacaacgccttggcagagaggagagcaagtgggggccaagccacaaagctcttcaaggccagtcaacagtgaaacctgaaggagtcccatccatccccaagtctgc

SEQ ID NO: 333451 - DNA, 183 bp, Homo sapiens
ctattcagttaacaggatctaatttaaagacctttccatgtgtctgcagaaaatttgtgggcttattaatgggctcattctgctagtaaatgtctataggcttccgaccatcaaacacacaagaggggagaagccatgacaaaaaacaacaacaacaaaaaccccaaccctgtctgttaccca

SEQ ID NO: 333452 - DNA, 446 bp, Homo sapiens
gaagcaccctggtttccacccactgggtccccatattacccaacttgagaagaccctgaaactccttctcggtttaaaaaccactggattagaaaaagatctgcaaggctaataacaaagtgctcaaagcatttacctctaaggaactgggtatgcctagattgaggtggctgggggaggggtaagcagtaatagaaagcaagattgaaatatcattttcactttttttgattctacatatttttatattatttgaacttttgtttgagtactttttactttttaatttaaaaagtaattaacaggaagaaactattgctctaaaaaagtatttttaatggttaaactttttcaaatggattcccatattttagtaaataatttccctatagcaggacattatttggctaaattacattgcaatgaaaatgaatatctctgtgcct

SEQ ID NO: 333453 - DNA, 304 bp, Homo sapiens
cttttctttctttctttgatggagtctcaaaaaaaggagaagggtgtccaaacatcctggatgaaaatggctccatgctgtcatagaattttatttactttataaatcctaatattttagaacttaaaaaagatactttgtagtttagatggttatagttaagctatttcattttttttaaaaaacgaagaaattagcattcaatgtctgcctagaaacaatcttatatacagtccttatgtacaaatcttttttgtggaatatgttttcgtagttttttgttttttgttttagattgggtctt

SEQ ID NO: 333454 - DNA, 6029 bp, Homo sapiens
  misc_feature (449)..(449): n is a, c, g, or t
ttcccggacccctgtttgctttagagccgagccgcgccgcgccgatgccctcacactctgcgcctcctctcccgggactttaacaccacgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaagncagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcgaggtctataaatgcacatggctctgtgctcattaaagctacccacgtgggcaatgacaccactttggctcagattgtgaaactggtggaagaggctcagatgtcaaagaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaaaat

SEQ ID NO: 333455 - DNA, 6685 bp, Homo sapiens
  misc_feature (449)..(449): n is a, c, g, or t
ttcccggacccctgtttgctttagagccgagccgcgccgcgccgatgccctcacactctgcgcctcctctcccgggactttaacaccacgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaagncagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcgaggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagaaatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgaatggctcagatgctgttgcgttcctgctttccagctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaaaat

SEQ ID NO: 333456 - DNA, 2660 bp, Homo sapiens
ctgtgtatgatctatcacttttttatttaaaaaagatgttcacttatttatgagtgcattcatttaacaaaagttagtggcagcctacaatgtgcaaggcatttgcttaggaagtttctaaatcaggtgagctttcctggaaccatagggagtttaatgtccttttccttggaaactcttgaggttttgatactgaatgttattaaaagatggatgagaggccttcaccaggcttagaaaaaaaaaaagccttgtttctagaatggctcagatgctgttgcgttcctgctttccagctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaaaat

SEQ ID NO: 333457 - DNA, 4720 bp, Homo sapiens
  misc_feature (449)..(449): n is a, c, g, or t
  misc_feature (4619)..(4619): n is a, c, g, or t
ttcccggacccctgtttgctttagagccgagccgcgccgcgccgatgccctcacactctgcgcctcctctcccgggactttaacaccacgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaagncagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcgaggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagaaatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgaatggctcagatgctgttgcgttcctgctttccagctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggcgggcngggttggcttccctcccacggtgggcggacagcccggggtggttggtaccccttaggggtcccgcccggtttcgtctgccggagcctgttgggcctggtgg

SEQ ID NO: 333458 - DNA, 2118 bp, Homo sapiens
  misc_feature (449)..(449): n is a, c, g, or t
ttcccggacccctgtttgctttagagccgagccgcgccgcgccgatgccctcacactctgcgcctcctctcccgggactttaacaccacgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaagncagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggtaagtaattcattaaaaaattgtagtcacctttttaaaaacagtaatatataatcagtgaagaaaaatgagaaaatatagctaaga

SEQ ID NO: 333459 - DNA, 6650 bp, Homo sapiens
  misc_feature (449)..(449): n is a, c, g, or t
ttcccggacccctgtttgctttagagccgagccgcgccgcgccgatgccctcacactctgcgcctcctctcccgggactttaacaccacgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaagncagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcgaggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagaaatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaaaat

SEQ ID NO: 333460 - DNA, 5678 bp, Homo sapiens
  misc_feature (449)..(449): n is a, c, g, or t
ttcccggacccctgtttgctttagagccgagccgcgccgcgccgatgccctcacactctgcgcctcctctcccgggactttaacaccacgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaagncagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcgaggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagaaatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaaaat

SEQ ID NO: 333461 - DNA, 3708 bp, Homo sapiens
cccctgaaatgtccttatgtgattagagttctgggagcttccttattgaactctcaacctgcctctgactctgtcctgttttcagaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaaaat

SEQ ID NO: 333462 - DNA, 375 bp, Homo sapiens
aagaactgagtcgacaatgctatgtatacattaaatatagtacaaaatgtacatttaatatagtgtaagatgaaggccatcgttttattcagattcttgtgaatagcttcctgtgaaccccccccacccttcaaaaaataaataaaggtcgaaaaagcgaaataagcataaaatgccatctgtcccctcagtttcatctaaccctaaggattgaattatgggagtaaaggccagggtgattccctggaatatccccagcacatcctagaatttcttgtaactctcatatctggcatcttttacagtgtttctcttcaagggcactgttggcattcagggtgaaacaatccttggcatgataggatgtttgccctc

SEQ ID NO: 333463 - DNA, 305 bp, Homo sapiens
gggagggcaggaaataatgacgtttaactaatttctgcacataattatggagtatttgctgtgtacccaatattgctagtcattgcttataaggagataatgaacttacaagcaagacaacattcatacgaggaaccattaaatagaagatgatacgtaattaagtgccaaatgattggtacgaatctcatgaacagatgacttgtttcatgctgaagatcctgcacagagacagacgtgctttcataaggagacagactgtttgagatgatcaggatcagaacgggaagtcagggatatgtggt

SEQ ID NO: 333464 - DNA, 102 bp, Homo sapiens
aaaaaaaagctctcaagcctcttccctgcttaagaagtgacccagactcagtcccctgctctaaagcagccaggatagtcccaagaggaggctaggcagaag

SEQ ID NO: 333465 - DNA, 449 bp, Homo sapiens
ctcactgcctctctgcaaacctcttaatacccttagtcaattgtaagaagctgcttggaaccctgtaagatggtctttggccagatcaagtcttgctcctcttcctctgaatcttgtaggggcctttaatctttctgtaactgtgattccccagaacaggatgcctttgttagcctagcatcttttctgttacttctatgaaacaaggagagacgctccctgggacccttaactatttctggaagcaaaatgacccttgccccactgaagacttaggagcctggtcacttccaaccgggcttttcatctttgtgactctcagtcatgggcaagaggctagctagctccaatcctaatgcccgtgccatcaactgcttcatttctggtttcttccttgcttttgtgataccctcattgactctttccactgtaccctgtggaaaacttgc

SEQ ID NO: 333466 - DNA, 156 bp, Homo sapiens
ccattctccatacataagtagaaatgtggtacacttaacggaaattttagcttttttatatttttccattattatgtcctcatgtttgacatctttttttcttctagttgcttatcattaatatgatgcagacattttgtttaaaaagacctcatt

SEQ ID NO: 333467 - DNA, 375 bp, Homo sapiens
gctccactggcccttgttaaagagaagacaacttccagtgacatgtaactgacaagtgagcatgtcactggcatgtgggtaaatttcctcaaaagcatgaagagtaaagctgtgaataagaatcataatattaatagtttaatgaaaacacataggacaatggtgaaagtcatgttctagaataaattacgattagcttgattctttaagattattctaccttttaagtaaaatagatatgattaaaggaagaaggacatttttattccatccatctttatgcttcaaatattcaacttctagaaacttggggaaaatccagactctctaaataggaacaggctgttaactactgcctgagtgaatcgtgtagct

SEQ ID NO: 333468 - DNA, 269 bp, Homo sapiens
gaattattagaaagttgtaagagctctgagggaattaaacaaagggctataataggaaatgagaagggctattttaagtagctcgttggaggttacatctgatctgagacttgagtgaagttgtagaaggtttttggggaaaatgctccatgcagacggaacacataagtgaagattctaaggcaacagtaagcttgatgttcaaggaacaaaaagaaggctggcacttggccaggtcttgtagtgctttgtggacaaaggtaacaagg

SEQ ID NO: 333469 - DNA, 89 bp, Homo sapiens
aatttagagtacaggaagtgtatacaaaagaatttcgaaacaatccttttttcctgtctgataaggatgatatctatccagttgacact

SEQ ID NO: 333470 - DNA, 109 bp, Homo sapiens
gttgtgaaaaaaaatttagtatctaagggtttacctcatcccaaactagatttttttcaaatgactccaggaagataagctaaagaagttagtgtacgatatttctttt

SEQ ID NO: 333471 - DNA, 546 bp, Homo sapiens
ccatgtgaccaaagaaacattgcttgcaatttttcaaaagatcttgaaaggtaaagaagttcatggatgccaaagagttgcttgacatacagggagattgaggagagggagcttcccattactcatcacagctttgaaagtgtaaatatggaataggtgtgtaaggctttttggggccatggaaagaggggtggttttaagaacaactttttgttgcctttctctttcagccgtgtaaaagagagataaatattcaataatgcgtttggacagtcttggataaaggtgactaagactgacatgctttttaaaacaatttttttaatgaaataaatgatggactatttgcttcttacaaaagataaagggccagttagtggttgttgaacagaagaaggaggtggtgttttcacagaggttaggatgggttgtaaacactttattattatacagagcctaatatctaatctttgtcatcagatccatacattggcataaaacttgaaatacttcaattcaagaagtatttattgaacagcatctatc

SEQ ID NO: 333472 - DNA, 321 bp, Homo sapiens
ggggagggggacggggtataaccttataagggggataatgcaacttaggcaatgtctggcaaaattgtaaccccatagtactcaaccagtgaggaactgggggagggacttgcgtgctaggagataaattacctgccgtaactgctccaggtgtgcctgcctaccagatatcccgtcttgcaagactgctataagaatctcacttctgctgttcatcgtgtctccaagtctattccttgagtttggacaggtgaatgagattcctacactcctcagctttcagtggtggttacccctagagtaaggcactgcaagagcctg

SEQ ID NO: 333473 - DNA, 1427 bp, Homo sapiens
tttcctcccaggggctgctgagccttcaggtgcttcagggtgctgagcagtcagctgtgtcctgggggcattctgaaggatgtagtttgggggaaggggactgtgtcagtcctgcctgggtgacccatcagctgcaggagacatcagccctgggcagctgcttcctgagataggtgtcaagtctcatcctgacctcagctctccccttcctggctaatgtcacagacctcctgcctgtaactggggcacagggcttcccctttggcctgtcccctccctcttttctagattgtggttggaaaaatcagacatagtcacggttggctcggactgaagagatgatccagcgtgtccttttctttttgcaggtagagaaaagtgaggcccagggagaaggactttgctaatagcagttaggagtgatagagtactttttatatgacagatctggtgcattttgtcctcacaaaaagacctgtcacatggggattctattatgcccacttcccaaatgtgagaggtaaaatggtactactttgggttagtagagggcatccaggaccccaggatctctgactagtagccctcccattgtgggtggtgttcccccgactgttccatcattccccttaccacccccatattttggaagggaacccaggctcagtacccagctgtcctctcctctgtttggctgggcttgctatactaaaccagttcttcctgtccagctgggagcattccctgatctgccttcctgccactccctctcaggccaattaaaggcagccttgttttgggagtcccctccacccaaaggtgttcctacccaggggcacagcctactgacttggccccgggcccaggcggttgtggggaagtgtcccccacctatcacctatcaagtgtactttagcttaaggacatttctggtcttctacagcgtcctcttcttgattacatgggagtaggggtgggggcggaagcctaggggcttctaggacccttgagtgaacagtgagagctcttgggacttcttgagcccagggagttatcaaacacccacgaaaatatttgggccatgatttggagggttccatgaggttggggggaggcctctttccccgctgggctgacatcccccaccttaaaatgaaaggtttgaacagggtagcctccagagtcctttccatctctcaatttgattaataacttaagtacctactattcaaaagaggtctctctcttgaaggaattaacttgagggaattaacatactccaccaaatgctgaatccctccctctctccccccgcacaccgagggcaggaactctgctctatttgtttttgtgaaatacctgtcccctagtttgtactcaggaaatgcttgtatgaatgaataaattcgtgcatgtaactttaaaaa

SEQ ID NO: 333474 - DNA, 217 bp, Homo sapiens
taatgagaaaaagaaagcccttccacatgattgacacttctgagtagtgtgatcccagttcatgtccattgtctgggatagctattaaataaaacttcctctcataaaattctctccatttagaagataaattctgtgattcacaagcctctttttatttataatagcccttcccctttctttatgaatttgaatttgttttttaaagaaactgtga

SEQ ID NO: 333475 - DNA, 1341 bp, Homo sapiens
ctgtgcagccagcccttctccatccttggcttcggtgacattgtggtccccggcttcctggttgcttactgttgccgctttgatgtgcaagtctgctcccgtcagatctacttcgtggcctgcaccgtggcctatgctgtgggcctgctggtcacattcatggccatggtcctcatgcagatgggccaacctgccttgctctacctagtgtccagcaccctgctcaccagcctggctgtggctgcctgccgccaagagctcagcctcttctggactggccagggcagagctaagatgtgtgggctcggctgtgccccttcggctggctctaggcagaagcaggagggcgcagcagatgcccacacagccagcacacttgagagaggcaccagccgaggagcaggggacttagacagcaaccctggagaagacaccactgagattgtcaccatatctgagaatgaagccaccaatccagaggaccgcagtgatagctccgagggctggagtgacgcccacttggatcctaatgagctgcccttcatcccccctggggcctcggaggagctgatgccactgatgccaatggccatgctgatcccactcatgcccctgatgcccccgccctcagagctgggccatgtccatgcccaggcccaggcccacgagactggcctgccctgggcgggactccacaagaggaagggtttgaaagtaagaaagagcatgtcgacccaggctcccttgtgaactggaggcactgggacacacgcctctcaaagggctggtggaacattgcagagcaaagccatgcatggcaacaagaaatcagggcatcaaagagatttcatatctacccaaggagtctctctgtttgtcgggagtgcaagagagcagcaaccacataataagagtgtgcagggctcgaagggtccttaggagtgggcaccacccccaaataatgaaggggggaaactgaggctccaagagggcctatgacttgcacaagttcaagcggcaaggtcgggatttgcatccagggctcactgggcagctactcccctctgcctgcttgcccaaccccttcccaatccagagtggcagcttcttagcctggcacacagcccccatcccatccctgccacccaccctaggctcattgcccatcttctctccatgctcaggtcaaacagaactccttgtcctccccacccgctctctctgcgtatgctgttccctccagctgggatgcccttccctctccagacagaaacactccagcctggctccctgactcactagaagattccgaagcatcctttactcctcagctcacatcca

SEQ ID NO: 333476 - DNA, 1044 bp, Homo sapiens
ctgtgcagccagcccttctccatccttggcttcggtgacattgtggtccccggcttcctggttgcttactgttgccgctttgatgtgcaagtctgctcccgtcagatctacttcgtggcctgcaggacacactgggcatttcctactgcctgttcgtcctgcaccgtgtgcggctgcccactctcaagaactgctcctccttccggctggagtgacgcccacttggatcctaatgagctgcccttcatcccccctggggcctcggaggagctgatgccactgatgccaatggccatgctgatcccactcatgcccctgatgcccccgccctcagagctgggccatgtccatgcccaggcccaggcccacgagactggcctgccctgggcgggactccacaagaggaagggtttgaaagtaagaaagagcatgtcgacccaggctcccttgtgaactggaggcactgggacacacgcctctcaaagggctggtggaacattgcagagcaaagccatgcatggcaacaagaaatcagggcatcaaagagatttcatatctacccaaggagtctctctgtttgtcgggagtgcaagagagcagcaaccacataataagagtgtgcagggctcgaagggtccttaggagtgggcaccacccccaaataatgaaggggggaaactgaggctccaagagggcctatgacttgcacaagttcaagcggcaaggtcgggatttgcatccagggctcactgggcagctactcccctctgcctgcttgcccaaccccttcccaatccagagtggcagcttcttagcctggcacacagcccccatcccatccctgccacccaccctaggctcattgcccatcttctctccatgctcaggtcaaacagaactccttgtcctccccacccgctctctctgcgtatgctgttccctccagctgggatgcccttccctctccagacagaaacactccagcctggctccctgactcactagaagattccgaagcatcctttactcctcagctcacatcca

SEQ ID NO: 333477 - DNA, 210 bp, Homo sapiens
ccaggagagaggcccagagaaaaatacataagtcatgcatgtttctatcgaatgctgcaggaaagccaaggaaggtgaagaatatctccttcaagaggacactgtcaggagagcaggggaggccagaactaaatcgcaagggagtaagaactgagtaggcaaggagggggtgggacagactggacaggaaacaatgcacagctgcactgg

SEQ ID NO: 333478 - DNA, 1079 bp, Homo sapiens
gtggctaagggggcaggtcctgggcttctggactgtccttgtctccaccccgcctgcccccagcgggccctccaggtgtctgcagggccctaggtgctggctggccaggtgggggtgttctcatagccggggatcctgcagctccccgttttctgctgccgccctgctctgctgctgactaggatagcagggctaaggacatggtgggagcctgtcccaaacagcacttcccccggcctggacatggtgccagtgccttctgtgtattcgttcactgagtccccacaacacccctgtgaagcaggcgctgtcatcacctgatgcatgaggaagcccagcgtcatgggtgtgtgacctgcctgaggtcccccacctggtgggcaggggtgtggcctctgccccatcctggtgccacgctggcttcctctgggatacactcgtctgagctgggctccctgtgggcagccctgtgccctgggaggtggagagaggggcctgcgggaagggagaggtgggcagggggaggctggggcccggctgtctctcaacgactgtttgcttccccagtcttctcaccaggccagtgggagccagcccctcccacagttggccagtgggcagcctggggcctcttctcttcttcgctctccttcctcctctcccctcacttctctatctcttctctctccacacagcgtttctggaccgcctgcctcagtggtccctctcgggggtggcctggggtcttggtgtctatgttggggggctgggagggcagtgactcttcatttgctgcgtcctgctcagtggcctgggtgggactgtggcctgaggtgtgactaaccgtggctttgtctctgtctgtctcccccaaaccccgtgctctgctgtgccttcccgcgcggcccctcacccgccgccgacccacagctccggaaaggcccaccagtccctccgcctcccaaacacaccccgtccaaggaagtcaagcaggagcagatcctcagcctgtttgaggacacgtttgtccctgagatcagcgtgaccaccccctcccaggtcagccgcggccgccgcgg

SEQ ID NO: 333479 - DNA, 2265 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333480 - DNA, 2457 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333481 - DNA, 2682 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagtttgaggccccggggcctttctcggagcaggccagtctgctggacctggactttgaccccctcccgcccgtgacgagccctgtgaaggcacccacgccctctggtcagtcaattccatgggacctctgggagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333482 - DNA, 2460 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagtttgaggccccggggcctttctcggagcaggccagtctgctggacctggactttgaccccctcccgcccgtgacgagccctgtgaaggcacccacgccctctggtcagtcaattccatgggacctctgggagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333483 - DNA, 2130 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333484 - DNA, 2553 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagtttgaggccccggggcctttctcggagcaggccagtctgctggacctggactttgaccccctcccgcccgtgacgagccctgtgaaggcacccacgccctctggtcagtcaattccatgggacctctgggagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333485 - DNA, 1975 bp, Homo sapiens
agcggagagaaagcctggccgggtgtctgacagtggccttccccctgcccgcctgcctgtcctctgtctgtgtctgcctgcctggggagcctcggtgtgagaacgccggggcacgagggtgtgcatcctgcctccgtggcccccgaccgcaggctctgctgggaggaaggggcgagacagggctcacttctcagcccgcccttcctgtgcaggcaggtggggaggagatgatgcggaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333486 - DNA, 1839 bp, Homo sapiens
caaagcatcacatttctttaatcaatgttttacatgacacgggagccttcaacgatgaagatgcaaggaccagagagaactgtctgttttcagacataagttggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333487 - DNA, 2641 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaaaaaaaaaaaagaaaaaaaaaaaaaaaaaaaaaaaaaaaaaaaaaaaaagggggggggcgccaaaaaatatccccccggggggccccattttcgcgcccccgttttttgtgaaaaaagggtggcgccccaataagaaggagagagcggcgtattatttaaacgacaaaagagcgaagggagggcaggagagtttaaaacaaaacgggttggatgcaagtggggaagaaaagttgtcaatgagagtggagagaaacaatttgtgggtggagaaggagagaacccctatccacttgtgtggggggggggggagcaacaaatagtgggggaccacaatcaactcaaacagaagagaatttaaaaacgcatcagaggggaaacaataattaaaatttaaaaggggttatataggtggtgttaaacacaacagggggaatatatagatggtagggctaggaaaaattagtggcaaaaagagagtaatatgaattattaggaacaatttttaattatg

SEQ ID NO: 333488 - DNA, 2526 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaaaatcggatttccggttaacactgtgacttcaattgaaacacctttttgtagtatctggaggtggacatt

SEQ ID NO: 333489 - DNA, 2414 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333490 - DNA, 2335 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggtgccccgcagacggtctgtgtgctgtttgaaaataaatcttagtgttcaaaacaaaatgaaacaaaaaaaaaatgataaaaactctcagaaaaa

SEQ ID NO: 333491 - DNA, 2223 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatctttccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333492 - DNA, 1205 bp, Homo sapiens
cctttgacagtggtaggagagaggatgtgggaggcgggtggctggccgggctccgctggtacccaccctgcccccaccaaccccagccgctggtgacattttctcttgtcttgtgatcctgcccattgcctttccaccccggcctccccgccccctccctgttctctcctcgtggcctgttaccagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333493 - DNA, 1226 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333494 - DNA, 1612 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333495 - DNA, 1380 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333496 - DNA, 1380 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333497 - DNA, 539 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333498 - DNA, 2349 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333499 - DNA, 2220 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333500 - DNA, 2328 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333501 - DNA, 2394 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333502 - DNA, 2175 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333503 - DNA, 2259 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333504 - DNA, 2153 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctgacccgtacctctgccaccagagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333505 - DNA, 2421 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333506 - DNA, 2326 bp, Homo sapiens
ccggcagctcctggccaccgctcgctgccctccttgttccgggatggctcctgccggttcagggcctgctctgctgttgcctgtggcattcatgggcctgggcccagggaatagagtcatgcggagaagttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagtttgaggccccggggcctttctcggagcaggccagtctgctggacctggactttgaccccctcccgcccgtgacgagccctgtgaaggcacccacgccctctggtcagtcaattccatgggacctctgggagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333507 - DNA, 1456 bp, Homo sapiens
gtcactctcgccggcagtgtcctcccgcagtgagccagcacagccccttccctgggcgggctgggcaccgggcagggtctgtgactcacctgctgcccgcagtcccttccccagcactctgtggccgtgtgatggggcctgagcaccactgcctggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333508 - DNA, 1585 bp, Homo sapiens
gtcactctcgccggcagtgtcctcccgcagtgagccagcacagccccttccctgggcgggctgggcaccgggcagggtctgtgactcacctgctgcccgcagtcccttccccagcactctgtggccgtgtgatggggcctgagcaccactgcctggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333509 - DNA, 2210 bp, Homo sapiens
gtggctaagggggcaggtcctgggcttctggactgtccttgtctccaccccgcctgcccccagcgggccctccaggtgtctgcagggccctaggtgctggctggccaggtgggggtgttctcatagccggggatcctgcagctccccgttttctgctgccgccctgctctgctgctgactaggatagcagggctaaggacatggtgggagcctgtcccaaacagcacttcccccggcctggacatggtgccagtgccttctgtgtattcgttcactgagtccccacaacacccctgtgaagcaggcgctgtcatcacctgatgcatgaggaagcccagcgtcatgggtgtgtgacctgcctgaggtcccccacctggtgggcaggggtgtggcctctgccccatcctggtgccacgctggcttcctctgggatacactcgtctgagctgggctccctgtgggcagccctgtgccctgggaggtggagagaggggcctgcgggaagggagaggtgggcagggggaggctggggcccggctgtctctcaacgactgtttgcttccccagtcttctcaccaggccagtgggagccagcccctcccacagttggccagtgggcagcctggggcctcttctcttcttcgctctccttcctcctctcccctcacttctctatctcttctctctccacacagcgtttctggaccgcctgcctcagtggtccctctcgggggtggcctggggtcttggtgtctatgttggggggctgggagggcagtgactcttcatttgctgcgtcctgctcagtggcctgggtgggactgtggcctgaggtgtgactaaccgtggctttgtctctgtctgtctcccccaaaccccgtgctctgctgtgccttcccgcgcggcccctcacccgccgccgacccacagctccggaaaggcccaccagtccctccgcctcccaaacacaccccgtccaaggaagtcaagcaggagcagatcctcagcctgtttgaggacacgtttgtccctgagatcagcgtgaccaccccctcccagtttgaggccccggggcctttctcggagcaggccagtctgctggacctggactttgaccccctcccgcccgtgacgagccctgtgaaggcacccacgccctctggtcagtcaattccatgggacctctgggagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333510 - DNA, 965 bp, Homo sapiens
gctcttgttcccttttgcaggcgcgttgtcaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333511 - DNA, 1531 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaagccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333512 - DNA, 982 bp, Homo sapiens
ggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaaa

SEQ ID NO: 333513 - DNA, 246 bp, Homo sapiens
cgccctcactgctgcgctcagtcaattccatgggacctctgggaggtaagctgcacgtctgctctttgtccagcccctgggggagccactcttccgtatgtgtccaggcccacatgctcctagcctgttcacaggtgcatgcaccccacacaccccccacacgcaggacacacaggcacgtgctcacgcacagggagctggtgaagccacccgcctccagccattctgctgcttctccctctggca

SEQ ID NO: 333514 - DNA, 424 bp, Homo sapiens
gcacaattaccatttgcatgagtcctcccaaatttgctgacgctgggtatcagcaaagggtgcaggggtaggtcagtgtagaaggtcatgtagttcatgcttttggtttggaattatgacccctatccaagcaactgttcatgttctagagaggacgaggaggaaacgattgggtcagatatgaaatacagtccatgttctggtgtgcatgtgaaaggctttgtagaggtggcccttcctgtcatatatcatatctgagtatgtcccacgtggtgtcccctgccccggctctggtcttggggtagtttttcaccactggcttctaattctcatactgttgctgctctaaggggcttaacttgcagcaactatctggattaatgattctcaaatggggggaccaagtgataagaaccattattgt

SEQ ID NO: 333515 - DNA, 2386 bp, Homo sapiens
gagcccgagggggcggggaggcgcgggcgggtgtgcgcgcgccgggcgtgggtgtgggtgggggtaaccggcgcgggcgccgagatagcgccgggcagagggacccggctaccctggacagcgcatcgccgcccgcccgggtcgccgcgccacagccgctgcggatcatggaacatctaaaggcctttgatgatgaaatcaatgcttttttggacaatatgtttggaccgcgagattctcgagtcagagggtggttcatgttggactcttaccttcctaccttttttcttactgtcatgtatctgctctcaatatggctgggtaacaagtatatgaagaacagacctgctctttctctcaggggtatcctcaccttgtataatcttggaatcacacttctctccgcgtacatgctggcagagctcattctctccacttgggaaggaggctacaacttacagtgtcaagatcttaccagcgcaggggaagctgacatccgggtagccaaggtgctttggtggtactatttctccaaatcagtagagttcctggacacaattttcttcgttttgcggaaaaaaacgagtcagattacttttcttcatgtatatcatcatgcttctatgtttaacatctggtggtgtgtcttgaactggataccttgtggacaaagtttctttggaccaacactgaacagttttatccacattcttatgtactcctactatggactttctgtgtttccatctatgcacaagtatctttggtggaagaaatatctcacacaggctcagctggtgcagttcgtgctcaccatcacgcacaccatgagcgccgtcgtgaaaccgtgtggcttccccttcggttgtctcatcttccagtcatcttatatgctaacgttagtcatcctcttcttaaatttttatgttcagacataccgaaaaaagccaatgaagaaagatatgcaagagccacctgcagggaaagaagtgaagaatggtttttccaaagcctacttcactgcagcaaatggagtgatgaacaagaaagcacaataaaaatgagtaacagaaaaagcacatatactagcctaacagattggcttgttttaaagcaaagactgaattgaaggttacatgttttaggataaactaatttcttttgagttcataaatcatttgtacccagaatgtattaatatattgctattaggttaatctgttaactgaatgctttgatcagcattgaggtgatgctcacctccgaggacctcagaactggtgcagcttctctctccctccctcccacagactgaacctttcgccagaagctgtccttataacgccttatacgcatacacagccaggaaacgtggagcattgtttctcacagagagtctccaaataaaaagggttttgttcagattaaaatgtttacaacaaaatgttaattatattctaaatacagggtatgttctaatctatattaagcaataatgccagtgcataatcattccatttgttcctttagcaatcaaccccagaaaatattaaaatgggatcatacacagaagatagaaaaatctagcaaaacttctctttctgtaagccagagtcttgtctatcagattcccacaaccactcctgattctaaatttagtgatatggtaatgaaattggtatttattttaaatattagttattctaaggagaaaaaaatgcttctgcaagattttcataattcaggggctgtggataggattgttcctctgtttccctaatcattcatctgttcatgtctccctcttgtgccagtcagcctaggttatacagatgccatgctccacaccacgagcagtgtacaaatctggctgcccgtttactttctgagcaagcactggagtccactccgacctttttctttgaacatgcatgctgctggaatatgtataaatcagaactagcagaagtagcagagtgatgggagcaaaataggcactgaattcgtcaactcttttttgtgagcctacttgtgaatattacctcagatacctgttgtcactcttcacaggttatttaagtttttgaagctgggaggaaaaagatggagtagcttggaaagattccagcactgagccgtgggccggtcatgagccacgataaaaaatgccagtttggcaaactcagcactcctgttccctgctcaggtatatgcgatctctactgagaagcaagcacaaaagtagacaaaagtattaatgagtatttcctttctccataagtgcaggactgttactcactactaaactctaccaagaatggaaacaaagaatattttctgaagatttttttgaagattaatttataccctataaaataaaacttgt

SEQ ID NO: 333516 - DNA, 2744 bp, Homo sapiens
gagcccgagggggcggggaggcgcgggcgggtgtgcgcgcgccgggcgtgggtgtgggtgggggtaaccggcgcgggcgccgagatagcgccgggcagagggacccggctaccctggacagcgcatcgccgcccgcccgggtcgccgcgccacagccgctgcggatcatggaacatctaaaggcctttgatgatgaaatcaatgcttttttggacaatatgtttggaccgcgagattctcgagtcagagggtggttcatgttggactcttaccttcctaccttttttcttactgtcatgtatctgctctcaatatggctgggtaacaagtatatgaagaacagacctgctctttctctcaggggtatcctcaccttgtataatcttggaatcacacttctctccgcgtacatgctggcagagctcattctctccacttgggaaggaggctacaacttacagtgtcaagatcttaccagcgcaggggaagctgacatccgggtagccaaggtgctttggtggtactatttctccaaatcagtagagttcctggacacaattttcttcgttttgcggaaaaaaacgagtcagattacttttcttcatgtatatcatcatgcttctatgtttaacatctggtggtgtgtcttgaactggataccttgtggacaaagtttctttggaccaacactgaacagttttatccacattcttatgtactcctactatggactttctgtgtttccatctatgcacaagtatctttggtggaagaaatatctcacacaggctcagctggtgcagttcgtgctcaccatcacgcacaccatgagcgccgtcgtgaaaccgtgtggcttccccttcggttgtctcatcttccagtcatcttatatgctaacgttagtcatcctcttcttaaatttttatgttcagacataccgaaaaaagccaatgaagaaagatatgcaagagccacctgcagggaaagaagtgaagaatggtttttccaaagcctacttcactgcagcaaatggagtgatgaacaagaaagcacaataaaaatgagtaacagaaaaagcacatatactagcctaacagattggcttgttttaaagcaaagactgaattgaaggttacatgttttaggataaactaatttcttttgagttcataaatcatttgtacccagaatgtattaatatattgctattaggttaatctgttaactgaatgctttgatcagcattgaggtgatgctcacctccgaggacctcagaactggtgcagcttctctctccctccctcccacagactgaacctttcgccagaagctgtccttataacgccttatacgcatacacagccaggaaacgtggagcattgtttctcacagagagtctccaaataaaaagggttttgttcagattaaaatgtttacaacaaaatgttaattatattctaaatacagggtatgttctaatctatattaagcaataatgccagtgcataatcattccatttgttcctttagcaatcaaccccagaaaatattaaaatgggatcatacacagaagatagaaaaatctagcaaaacttctctttctgtaagccagagtcttgtctatcagattcccacaaccactcctgattctaaatttagtgatatggtaatgaaattggtatttattttaaatattagttattctaaggagaaaaaaatgcttctgcaagattttcataattcaggggctgtggataggattgttcctctgtttccctaatcattcatctgttcatgtctccctcttgtgccagtcagcctaggttatacagatgccatgctccacaccacgagcagtgtacaaatctggctgcccgtttactttctgagcaagcactggagtccactccgacctttttctttgaacatgcatgctgctggaatatgtataaatcagaactagcagaagtagcagagtgatgggagcaaaataggcactgaattcgtcaactcttttttgtgagcctacttgtgaatattacctcagatacctgttgtcactcttcacaggttatttaagtttttgaagctgggaggaaaaagatggagtagcttggaaagattccagcactgagccgtgggccggtcatgagccacgataaaaaatgccagtttggcaaactcagcactcctgttccctgctcaggtatatgcgatctctactgagaagcaagcacaaaagtagacaaaagtattaatgagtatttcctttctccataagtgcaggactgttactcactactaaactctaccaagaatggaaacaaagaatattttctgaagatttttttgaagattaatttataccctataaaataaaacttgttagcttcgatgaagtcacttcatcttctctcctaccttatttttttaaataagtttttaggtcctgacactgacatcaaatacatgcacaccagaaaggcatttccaccaccgtccccactcattagcgtccagagtgcctttctctctcggctttttttcccccctgagctctagttttaaactttctcctgttaaaaaaattgtacttttatttcatgtaaactgcccctctgaggatttgggcatattttttggaaggtgcctaatgcttaggatagtctctagggtgatgcactgcacctgcttccttcccttcagtgcggccgacccatttctgttgaacagatgtctcctgt

SEQ ID NO: 333517 - DNA, 227 bp, Homo sapiens
tgctatttatcggctcttccagaaccttctccttcttggttatggaagttggtccccatgacgatgatgcaatgagggctttgctttaagtctgactgaatcgggggacaaagtcaaacttgaggttaacaatgccactgggttaagaaggtggtggtgccgatgaatagcgaggtgccgatggatagcgaggtgccgatgaatagcgaggtgccgatgaatagcga

SEQ ID NO: 333518 - DNA, 407 bp, Homo sapiens
ctgagggcgagcgggtagtggaagagaaaccataatgaagcagagatctttaaaacaatccaaatagaacacactagaagacaagggcaggtgtgataggcataaaagaaaagcccatcgcatgcaataaccaaaaggaaaaaaaatgaaataggggaacctgaaatatttcaccatcatgggccaaactgaaacactgtggggaagcactgaagacagacattttagaaaagtttagagagaatgtgttctcaaaaggggaagaataacatcaaattatagcctatgtcggggctgggggagttagtaatagaggataggcagcaccaaaatctcaaaggagattttacaggtgggataggatttttttgtttcgttttgaaatgaagatgccaaaacatgcagat

SEQ ID NO: 333519 - DNA, 475 bp, Homo sapiens
gccatgccatttgaggatgcaaaaggagggcggtattcaggagagtgtgtcagagcccaccagatacattggagtttatccacctaaactactaattactacatgggcatgaatgctggcatattgagaagtacctattcttacatgagctcccctggcatatttatagaaccaataggagcagtcttctaaatgtacttcacccagagaagaaagtcaaagatcatgcatttttattcctaacccattaaataactctaatgctgaagatggtattaagtgtctaaatatctaaagaaaatataaataccttttatagccatttggttttctaataggcaatagtatatttcaagctcagaaatctaagaataagcctttggtcttaactgtattcaactttttaccttgagatttcaatatatgtaaaaaaaataaaatactgatctggaataaaatccaaaaaggtatattt

SEQ ID NO: 333520 - DNA, 747 bp, Homo sapiens
tctgtaaaatcggatggaccgccaatcggagaatgagagctgcccagcctggtcttacattctttcaattaattcataaacagggggatatgcagggagccgaaggcccatgggacgtgaccaactcagcattccactggaggctatatgatcaaacagcaaactgtttatcatgaatacaggatgtgagcaaactcacgactgtgcctgccgccagaaggtttgctgagggcaatcgcttcctgacgccaagctctttgaagttatctactggaacatctagagaatgcagtcttgcaagcctactctggaccaaccaactgacctcttcttccaccccccttctcactatcgcttttctctaataaatacagagggccgtgtaaagctcagggccttgtccactagaggcaaggtgcccccggaccccttcttccaaatatactcttttgtctcttgtcttttattcctgcattcacccccctttgttcagtccaccagggatcatggcaggttacatagtggcgccccgaacagccacagaatcgggtgctcgatagatcctcatatataactataatttgagccccaatgtaaagtccataaatttttgtcaatttgagcatttttgctgttgttgaagttaagttagtacctatgttgtaaaggcacaaaaccaaatcagtgcctttttatccttttgttacataatttttttggtataaaaattaatatatgaattttgaa

SEQ ID NO: 333521 - DNA, 134 bp, Homo sapiens
tgtccaagtcagacaactgaagatgtagcgtgtaaatttcaacagcacagtttgcaaaaagtgcatgtgtccttcatgcctacctcttaggtaggacgcaattcttccttctgagatttgtattccttagttct

SEQ ID NO: 333522 - DNA, 434 bp, Homo sapiens
acacaggccgttaggttcttcctgaaggttataaagccccacagcattcataatgtgctttttggaccccacaagagccccctccatgcagatggcaccagtgcagctgacaggctcagtcccctgacaccccctccacaccgcagctctggagccagcagatgctgctttgagaacggccacatctgttcctgtccctgtgtggccaccttgatttctacatgacttttttatttttggccaatgaagtatgcatcaatccatactcaggtgttttgtgaacagggctggggacctcttggtgccatgcttagtgcccccctgccccccgccacagaacaagacttttcctagttgagcaccttctgtctcttcaagggcttccatcgtgcttcatacatctacccgcttactccttcaaaaaatatttaata

SEQ ID NO: 333523 - DNA, 1608 bp, Homo sapiens
ggtagtttgagtcatttccacatcttgcgagtccttccgaacgagtctcctttccttggggctcgcaaccacccaatgatcgattcaggagaaaagaagcctgggcggagagcagagcccgacctttctaaaagagctgcaggaagggacttcttggctactgatggcaaagctctacgaggcagtgaccttcaaggatgtggctgtgatcttcactgaggaggagctggggctgctggaccctgcccagaggaagctgtaccgagatgtgatgcttgagaacttcaggaacctgctctcagtgggaggcaagatccaaactgagatggagacttttccagaagcaggaacacatgaagaattttcctgcaagcaaatttgggaacaaattgcaagtgacttaaccaggtctcaagataccaccataagtaactctcagttatttgaacaagatgacaacccctcccagattaaagcaagactatctacagttcacacaagagaaaaacctttccagggtgaaaattgtaaacagttcttcagtgatgtttccttctttgatcttcctcagcagttatattcaggagagaagtctcatacctgtgatgagtgtggaaaaagcttctgttacatctcagcccttcatattcatcagagggtccacatgggagtgaaatgctataagtgtgatgtgtgtggtaaggaatttagtcagagctcacgtctgcaaactcatcaaagagtccacactggagagaaaccattcaaatgtgagcagtgtgggaaaggcttcagatgtagatcagcacttaaagttcattgcaaattacacatgagagagaaaccttataattgtgagaaatgtgggaaggctttcatgcacaatttccagcttcagaaacatcacagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgaggagtgtgggaagggctacattagtaagtcaggtcttgacttccaccatagaacccacacgggagagagatcttataactgtgataactgcgggaagagctttagacatgcttctagtattttgaatcataagaaactccactgccaaagaaagccattgaaatgtgaagactgtggaaagaggcttgtatgccggtcatactgtaaagaccaacaaagagaccacagtggagaaaacccatccaaatgtgaggactgtgggaagcgctacaagaggcgcttgaatctggatataattttatcattatttttaaatgacatataagttatacatatttatggagtgtgaaatttgatacatgtatataatgtgtgctgattaaatcagtttaatttcacctgaaaaaaaaaatg

SEQ ID NO: 333524 - DNA, 1701 bp, Homo sapiens
ggtagtttgagtcatttccacatcttgcgagtccttccgaacgagtctcctttccttggggctcgcaaccacccaatgatcgattcaggagaaaagaagcctgggcggagagcagagcccgacctttctaaaagagctgcaggaagggacttcttggctactgatggcaaagctctacgaggcagtgaccttcaaggatgtggctgtgatcttcactgaggaggagctggggctgctggaccctgcccagaggaagctgtaccgagatgtgatgcttgagaacttcaggaacctgctctcagtggggcatcaaccattccatggagatactttccacttcctaagggaagaaaagttttgggtgatggggacaacaagccaaagagaagggaatttgggaggcaagatccaaactgagatggagacttttccagaagcaggaacacatgaagaattttcctgcaagcaaatttgggaacaaattgcaagtgacttaaccaggtctcaagataccaccataagtaactctcagttatttgaacaagatgacaacccctcccagattaaagcaagactatctacagttcacacaagagaaaaacctttccagggtgaaaattgtaaacagttcttcagtgatgtttccttctttgatcttcctcagcagttatattcaggagagaagtctcatacctgtgatgagtgtggaaaaagcttctgttacatctcagcccttcatattcatcagagggtccacatgggagtgaaatgctataagtgtgatgtgtgtggtaaggaatttagtcagagctcacgtctgcaaactcatcaaagagtccacactggagagaaaccattcaaatgtgagcagtgtgggaaaggcttcagatgtagatcagcacttaaagttcattgcaaattacacatgagagagaaaccttataattgtgagaaatgtgggaaggctttcatgcacaatttccagcttcagaaacatcacagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgaggagtgtgggaagggctacattagtaagtcaggtcttgacttccaccatagaacccacacgggagagagatcttataactgtgataactgcgggaagagctttagacatgcttctagtattttgaatcataagaaactccactgccaaagaaagccattgaaatgtgaagactgtggaaagaggcttgtatgccggtcatactgtaaagaccaacaaagagaccacagtggagaaaacccatccaaatgtgaggactgtgggaagcgctacaagaggcgcttgaatctggatataattttatcattatttttaaatgacatataagttatacatatttatggagtgtgaaatttgatacatgtatataatgtgtgctgattaaatcagtttaatttcacctgaaaaaaaaaatg

SEQ ID NO: 333525 - DNA, 1640 bp, Homo sapiens
ggtagtttgagtcatttccacatcttgcgagtccttccgaacgagtctcctttccttggggctcgcaaccacccaatgatcgattcaggagaaaagaagcctgggcggagagcagaggaggcagtgaccttcaaggatgtggctgtgatcttcactgaggaggagctggggctgctggaccctgcccagaggaagctgtaccgagatgtgatgcttgagaacttcaggaacctgctctcagtggggcatcaaccattccatggagatactttccacttcctaagggaagaaaagttttgggtgatggggacaacaagccaaagagaagggaatttgggaggcaagatccaaactgagatggagacttttccagaagcaggaacacatgaagaattttcctgcaagcaaatttgggaacaaattgcaagtgacttaaccaggtctcaagataccaccataagtaactctcagttatttgaacaagatgacaacccctcccagattaaagcaagactatctacagttcacacaagagaaaaacctttccagggtgaaaattgtaaacagttcttcagtgatgtttccttctttgatcttcctcagcagttatattcaggagagaagtctcatacctgtgatgagtgtggaaaaagcttctgttacatctcagcccttcatattcatcagagggtccacatgggagtgaaatgctataagtgtgatgtgtgtggtaaggaatttagtcagagctcacgtctgcaaactcatcaaagagtccacactggagagaaaccattcaaatgtgagcagtgtgggaaaggcttcagatgtagatcagcacttaaagttcattgcaaattacacatgagagagaaaccttataattgtgagaaatgtgggaaggctttcatgcacaatttccagcttcagaaacatcacagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgaggagtgtgggaagggctacattagtaagtcaggtcttgacttccaccatagaacccacacgggagagagatcttataactgtgataactgcgggaagagctttagacatgcttctagtattttgaatcataagaaactccactgccaaagaaagccattgaaatgtgaagactgtggaaagaggcttgtatgccggtcatactgtaaagaccaacaaagagaccacagtggagaaaacccatccaaatgtgaggactgtgggaagcgctacaagaggcgcttgaatctggatataattttatcattatttttaaatgacatataagttatacatatttatggagtgtgaaatttgatacatgtatataatgtgtgctgattaaatcagtttaatttcacctgaaaaaaaaaatg

SEQ ID NO: 333526 - DNA, 114 bp, Homo sapiens
agaggaattgcgatggtttaaaataaatcttctgcaaaaaagtacttaaaatttgccttgaatataggtaaaagtaaaaatgaaggtaaaggcaaacaagacaagtcaaaagaa

SEQ ID NO: 333527 - DNA, 567 bp, Homo sapiens
aggggacaaagaagcagagaaggatgatcagaaggggacccccagcccttggaggagagacggcagcctcaggccgccacaaaggattttgtggagtcgccccaggcctgacggcgttaattatccctggctttcatcttgatgctcttgcaggggaggctcaagatgccttgtggctcgacccctgcacggagcccccagcccagcctccccgtgggttgaaaccttgatctgggcctgactgtggctgctctggggacatgccctcgtcctttgctgaagctgaggctccagagggggagtcactgccacgaaggttgcccagaactttccttgctgcaaaaagccccaagacttctccctgccacacacacagcttttgccatcgcgttctaaaagctgacagctttctctccaacactgttctccctgagtagggtaaagctacacttggcttccccagtttcctgtttcctgcctagaaacaaatttttgtcagtctgcttttcaaatgggatatatgattcacataccataaaattcaccactttatataaaaaaaaagtt

SEQ ID NO: 333528 - DNA, 2878 bp, Homo sapiens
tttgccaatttgacttctgtaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctggatgtgaattcggtggttttgaatgcataaagtgccttgtggacacgggggagttgtggtgcttctgggtctctgggccccgcctgctggcctgggatgccctcatgttgggaagcattccgtgccccccaccccgcctgccctccctgattaacacccctaataaggggttggggtgcccataacggggtggccctgccgctgactcgggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctgcgccaggcagttaccgagccgaagggagatgatgggccttcgcccctcagtgggatggcagctgagggggccctgcatttgaccctcgagactgcagcagcgcctttcctgtctgtggtttaagtctttgcagtcaagtactgatgcatccaagccaggcctatgcctggtgtctccctgactgcagaggagccccagggcaaggacagctcagctgctggcagcctgcctggcccatagacatcccccaagtagtctcaggcctctgacatgtccctgaggggcccctaagaaagaaagtggaggggacactccagaggctgtcgtgggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacaaggtcaggagattgagaccatcctggctaacacagtgaaaccccgtctctactaaaaatacaaaaaaattagccaggcgtggtggcggtcacctgtagtcccagctactcgggaggctgaagcaggagaatggcgtgaacctgggaggcggagcttgcagtgagccgagatcacaccactgcactccagcctgagcgacagagcaagactccatctcaaaaaaaaaa

SEQ ID NO: 333529 - DNA, 628 bp, Homo sapiens
cgggagagatacagtgcagtgagcatatacaatatgtatattagagtataccgggggatccctgattgattaaagtatagtctatgactaatagtgagtttctaagatggccttaaaagtattattaccgtactggttcaaaaccttaaattcgcggtgaacacaggtccgtagaccttgatagttcggaaaagcaatggaaatagcatcaacatacgtcgctcaatgatccgtatactatggatgatccagattgacgctcgtcaaggggaggctcaagatgccttgtggctcgacccctgcacggagcccccagcccagcctccccgtgggttgaaaccttgatctgggcctgactgtggctgctctggggacatgccctcgtcctttgctgaagctgaggctccagagggggagtcactgccacgaaggttgcccagaagccatcgcgttctaaaagctgacagctttctctccaacactgttctccctgagtagggtaaagctacacttggcttccccagtttcctgtttcctgcctagaaacaaatttttgtcagtctgcttttcaaatgggatatatgattcacataccataaaattcaccactttatataaaaaaaaagtt

SEQ ID NO: 333530 - DNA, 2817 bp, Homo sapiens
tttgccaatttgacttctgtaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagaggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctggatgtgaattcggtggttttgaatgcataaagtgccttgtggacacgggggagttgtggtgcttctgggtctctgggccccgcctgctggcctgggatgccctcatgttgggaagcattccgtgccccccaccccgcctgccctccgtatttcctgcacctgtcagcctgcgccgactgatgagccagttgctcatttgtgctgattaacacccctaataaggggttggggtgcccataacggggtggccctgccgctgactcgggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctgcgccaggcagttaccgagccgaagggagatgatgggccttcgcccctcagtgggatggcagctgagggggccctgcatttgaccctcgagactgcagcagcgcctttcctgtctgtggtttaagtctttgcagtcaagtactgatgcatccaagccaggcctatgcctggtgtctccctgactgcagaggagccccagggcaaggacagctcagctgctggcagcctgcctggcccatagacatcccccaagtagtctcaggcctctgacatgtccctgaggggcccctaagaaagaaagtggaggggacactccagaggctgtcgtgggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacaaggtcaggagattgagaccatcctggctaacacagtgaaaccccgtctctactaaaaatacaaaaaaattagccaggcgtggtggcggtcacctgtagtcccagctactcgggaggctgaagcaggagaatggcgtgaacctgggaggcggagcttgcagtgagccgagatcacaccactgcactccagcctgagcgacagagcaagactccatctcaaaaaaaaaa

SEQ ID NO: 333531 - DNA, 2944 bp, Homo sapiens
gagtttcctgtcagggaagctgacatgtcggtcgcgtgaaagcacgaggcctgtgtggtgggttcggtgggtgccgctggctgctggttatattcacactcagcatagacgcatagcgagctgggagtgaagccttcacaacaaaagcatagaatacagctactgtaaaaaataagaaatttaaaaattttcagaaatgatagcactttttgaaggaaaataaggatttcatttttaaaaaatcactttgctggttttgtaacttctgctgcaccctcactccatgcttccatacctatttttaaggttcttaaactggacccagacacatcagcaataggccatggttgtcgtaacacaaagggactgagattcttgttcttgctttagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctggatgtgaattcggtggttttgaatgcataaagtgccttgtggacacgggggagttgtggtgcttctgggtctctgggccccgcctgctggcctgggatgccctcatgttgggaagcattccgtgccccccaccccgcctgccctccgtatttcctgcacctgtcagcctgcgccgactgatgagccagttgctcatttgtgctgattaacacccctaataaggggttggggtgcccataacggggtggccctgccgctgactcgggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctgcgccaggcagttaccgagccgaagggagatgatgggccttcgcccctcagtgggatggcagctgagggggccctgcatttgaccctcgagactgcagcagcgcctttcctgtctgtggtttaagtctttgcagtcaagtactgatgcatccaagccaggcctatgcctggtgtctccctgactgcagaggagccccagggcaaggacagctcagctgctggcagcctgcctggcccatagacatcccccaagtagtctcaggcctctgacatgtccctgaggggcccctaagaaagaaagtggaggggacactccagaggctgtcgtgggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacaaggtcaggagattgagaccatcctggctaacacagtgaaaccccgtctctactaaaaatacaaaaaaattagccaggcgtggtggcggtcacctgtagtcccagctactcgggaggctgaagcaggagaatggcgtgaacctgggaggcggagcttgcagtgagccgagatcacaccactgcactccagcctgagcgacagagcaagactccatctcaaaaaaaaaa

SEQ ID NO: 333532 - DNA, 2803 bp, Homo sapiens
tttgccaatttgacttctgtaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctggatgtgaattcggtggttttgaatgcataaagtgccttgtggacacgggggagttgtggtgcttctgggtctctgggccccgcctgctggcctgggatgccctcatgttgggaagcattccgtgccccccaccccgcctgccctccgtatttcctgcacctgtcagcctgcgccgactgatgagccagttgctcatttgtgctgattaacacccctaataaggggttggggtgcccataacggggtggccctgccgctgactcgggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctgcgccaggcagttaccgagccgaagggagatgatgggccttcgcccctcagtgggatggcagctgagggggccctgcatttgaccctcgagactgcagcagcgcctttcctgtctgtggtttaagtctttgcagtcaagtactgatgcatccaagccaggcctatgcctggtgtctccctgactgcagaggagccccagggcaaggacagctcagctgctggcagcctgcctggcccatagacatcccccaagtagtctcaggcctctgacatgtccctgaggggcccctaagaaagaaagtggaggggacactccagaggctgtcgtgggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacacagcgttagccaccgcactcgacccaaatgacactgtcttaaatgatttaatgtcttaaatcgggaaaggagagtaagaggaagcaccccatggtca

SEQ ID NO: 333533 - DNA, 2808 bp, Homo sapiens
tttgccaatttgacttctgtaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctggatgtgaattcggtggttttgaatgcataaagtgccttgtggacacgggggagttgtggtgcttctgggtctctgggccccgcctgctggcctgggatgccctcatgttgggaagcattccgtgccccccaccccgcctgccctccgtatttcctgcacctgtcagcctgcgccgactgatgagccagttgctcatttgtgctgattaacacccctaataaggggttggggtgcccataacggggtggccctgccgctgactcgggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctgcgccaggcagttaccgagccgaagggagatgatgggccttcgcccctcagtgggatggcagctgagggggccctgcatttgaccctcgagactgcagcagcgcctttcctgtctgtggtttaagtctttgcagtcaagtactgatgcatccaagccaggcctatgcctggtgtctccctgactgcagaggagccccagggcaaggacagctcagctgctggcagcctgcctggcccatagacatcccccaagtagtctcaggcctctgatctgagcaaacctgggtgtgaattcggtggttttgaatgcataaagtgccttgtggacacgggggagttgtggtgctccagagggggagtcactgccacgaaggttgcccagaactttccttgctgcaaaaagccccaagacttctccctgccacacacacagcttttgccatcgcgttctaaaagctgacagctttctctccaacactgttctccctgagtagggtaaagctacacttggcttccccagtttcctgtttcctgcctagaaacaaatttttgtcagtctgcttttcaaatgggatatatgattcacataccataaaattcaccactttatataaaaaaaaagtt

SEQ ID NO: 333534 - DNA, 1981 bp, Homo sapiens
gctcagctgtgggggcgtgctgttccccaggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagagcggggtcgcctctgggcctctgtctgagcaaacctggatgtgaattcggtggttttgaatgcataaagtgccttgtggacacgggggagttgtggtgcttctgggtctctgggccccgcctgctggcctgggatgccctcatgttgggaagcattccgtgccccccaccccgcctgccctccgtatttcctgcacctgtcagcctgcgccgactgatgagccagttgctcatttgtgctgattaacacccctaataaggggttggggtgcccataacggggtggccctgccgctgactcgggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctgcgccaggcagttaccgagccgaagggagatgatgggccttcgcccctcagtgggatggcagctgagggggccctgcatttgaccctcgagactgcagcagcgcctttcctgtctgtggtttaagtctttgcagtcaagtactgatgcatccaagccaggcctatgcctggtgtctccctgactgcagaggagccccagggcaaggacagctcagctgctggcagcctgcctggcccatagacatcccccaagtagtctcaggcctctgacatgtccctgaggggcccctaagaaagaaagtggaggggacactccagaggctgtcgtgggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacaaggtcaggagattgagaccatcctggctaacacagtgaaaccccgtctctactaaaaatacaaaaaaattagccaggcgtggtggcggtcacctgtagtcccagctactcgggaggctgaagcaggagaatggcgtgaacctgggaggcggagcttgcagtgagccgagatcacaccactgcactccagcctgagcgacagagcaagactccatctcaaaaaaaaaa

SEQ ID NO: 333535 - DNA, 789 bp, Homo sapiens
tttgccaatttgacttctgtaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagaggcaggtgccctggggcagtgcagcggggttgaggaggggccccgagactgcatgtgcatttgaactaaaaacctgatgtatgggcaggcacagtggcttatgcctgtgatcccagcacttggagaggctgaggcaggaggatcacttgagcccataagttcaagaccagcctggacaatatagcaagaccatgtcttttttgtttgtttgtttttttgtttttttttttttgcctcaaggtttgtggatctacaaaaaatttttgaaaaaattagccagacatggtagcgtgcacctgtggtcccagctactcaggaggattgctggatcccagaagttcaaggctgcagtgaatcgtgatcacaccactgcatattccagcatgggtgacagagcaataccctatctct

SEQ ID NO: 333536 - DNA, 663 bp, Homo sapiens
tttgccaatttgacttctgtaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctggtgagactcctggagttagagcagcttgcctgtctcctcctcagaaggcacagggtgtggtttcgggtcctcctctgggtctcatctctgttgatgttagttgatgatcttagtgatggggcacgtggagcttcttgaaaatgacagggtgaaacgcaggcctgcgtgctaaatcccacgctcagcaaatcccagcaggctgggagaggcgctgcgtgcttggaaagccgtgatacaggctgctcattttcccatgagcctgtgtattttacatgtatgttacatatatcctttcatatgtgtggctatttcttaatttaaaacaaatgcggaggctgggcacggtggctcatgcctgttatcccaacactttgggaggctaaggcaggcggatcacttgaggtcaggagttcgagaccagcctggccaaca

SEQ ID NO: 333537 - DNA, 322 bp, Homo sapiens
acagcacgcgctaacaaaggtgctgccgcgggccgtgccaccgtcttccctctttcccccaggtgggattccccaacgccgggaagtcctcactgctccgggccatttcaaacgccagacccgccgtggcttcctacccgttcaccaccctgaagccccacgtcgggatcgtccactacgaaggccacctacaaatagcaggtagaacttccagaattctcccaaaggttagatttaaatgatgtaattcagagaagtaatgatgtaactcttaaatttagctttctgtttagaatgtagcattgttagcgcgtcgtggtgg

SEQ ID NO: 333538 - DNA, 468 bp, Homo sapiens
aggggacaaagaagcagagaaggatgatcagaaggggacccccagcccttggaggagagacggcagcctcaggccgccacaaaggattttgtggagtcgccccaggcctgacggcgttaattatccctggctttcatcttgatgctcttgcaggggaggctcaagatgccttgtggctcgacccctgcacggagcccccagcccagcctccccgtgggttgaaaccttgatctgggcctgactgtggctgctctggggacatgccctcgtcctttgctgaagctgaggctccagagggggagtcactgccacgaaggttgcccagaactttccttgctgcaaaaagccccaagacttctccctgccacacacacagcttttgccatcgcgttctaaaagctgacagctttctctctccactcccgggagtggagagagaatgggggagaataagagaggatgagttca

SEQ ID NO: 333539 - DNA, 2933 bp, Homo sapiens
tttgccaatttgacttctgtaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctggatgtgaattcggtggttttgaatgcataaagtgccttgtggacacgggggagttgtggtgcttctgggtctctgggccccgcctgctggcctgggatgccctcatgttgggaagcattccgtgccccccaccccgcctgccctccgtatttcctgcacctgtcagcctgcgccgactgatgagccagttgctcatttgtgctgattaacacccctaataaggggttggggtgcccataacggggtggccctgccgctgactcgggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctgcgccaggcagttaccgagccgaagggagatgatgggccttcgcccctcagtgggatggcagctgagggggccctgcatttgaccctcgagactgcagcagcgcctttcctgtctgtggtttaagtctttgcagtcaagtactgatgcatccaagccaggcctatgcctggtgtctccctgactgcagaggagccccagggcaaggacagctcagctgctggcagcctgcctggcccatagacatcccccaagtagtctcaggcctctgacatgtccctgaggggcccctaagaaagaaagtggaggggacactccagaggctgtcgtgggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacaaggtcaggagattgagaccatcctggctaacacagtgaaaccccgtctctactaaaaatacaaaaaaattagccaggcgtggtggcggtcacctgtagtcccagctactcgggaggctgaagcaggagaatggcgtgaacctgggaggcggagcttgcagtgagccgagatcacaccactgcactccagcctgagcgacagagcaagactccatctcaaaaaaaaaa

SEQ ID NO: 333540 - DNA, 2468 bp, Homo sapiens
gctcagctgtgggggcgtgctgttccccaggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctggatgtgaattcggtggttttgaatgcataaagtgccttgtggacacgggggagttgtggtgcttctgggtctctgggccccgcctgctggcctgggatgccctcatgttgggaagcattccgtgccccccaccccgcctgccctccgtatttcctgcacctgtcagcctgcgccgactgatgagccagttgctcatttgtgctgattaacacccctaataaggggttggggtgcccataacggggtggccctgccgctgactcgggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctgcgccaggcagttaccgagccgaagggagatgatgggccttcgcccctcagtgggatggcagctgagggggccctgcatttgaccctcgagactgcagcagcgcctttcctgtctgtggtttaagtctttgcagtcaagtactgatgcatccaagccaggcctatgcctggtgtctccctgactgcagaggagccccagggcaaggacagctcagctgctggcagcctgcctggcccatagacatcccccaagtagtctcaggcctctgacatgtccctgaggggcccctaagaaagaaagtggaggggacactccagaggctgtcgtgggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacaaggtcaggagattgagaccatcctggctaacacagtgaaaccccgtctctactaaaaatacaaaaaaattagccaggcgtggtggcggtcacctgtagtcccagctactcgggaggctgaagcaggagaatggcgtgaacctgggaggcggagcttgcagtgagccgagatcacaccactgcactccagcctgagcgacagagcaagactccatctcaaaaaaaaaa

SEQ ID NO: 333541 - DNA, 1249 bp, Homo sapiens
tttgccaatttgacttctgtaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgagggcagaaagtatatgtgtcaggtgtgaggaagaaaatagattttggaagttaggagaacgcgtca

SEQ ID NO: 333542 - DNA, 1058 bp, Homo sapiens
tttgccaatttgacttctgtaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcaggttcccaccccatcccctaggaatctgtcagttacagttcagaaacctgcattgaaattccagccgaggacagtatttcttcccactctatttgtcccctctcatctgtggaagctcagcagcatcacaacacgtgacttaaaagctttccttgtgccgtttgagagaataaaactttttcccagaagacaatacacccattaaa

SEQ ID NO: 333543 - DNA, 793 bp, Homo sapiens
tttgccaatttgacttctgtaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtgagccgagactgccggacctggccctgtccccgttgttctggatcatccagctcctgggggccaccgtgtgacccacggggcccctgtggcttgatgcccacagctaggaaacagcacaatggaaacggaggctggcagacagcgggaaagcagccccacccctcaaagcaaacccagacgggcatttgtaccagggtctcacaccatgtgcatgtctagtgaaaaagtcatgaaacgattctcttttaaaaagagggagcccacggcacggacgcttcctccgtctctgacccca

SEQ ID NO: 333544 - DNA, 812 bp, Homo sapiens
ccaaaatatattttggagatagtttgatatgagaggtgaggaaaagtaagtagtcatgtgtggctctttgtttctggctttaataactccagtagttctggaagagacttagtgggaaacattttggataaactgagtttgtccaaatggggttgccaagtggagagttgagtaaatgaagctagagctcaggaaagatgtggaccagagttataagtcatatttatttatttatttattttgagacagagtcgtgctctgtcgcccaggctggagtgcagtggtgcgatcttggctcactgcaacctccgcctccggggtcaagtgattctcctacctcagcctccagagtagctggtattacaggcacgggccaccatgcccagctaatttttgtatttttagtagagacgggggtttcaccatgctggccaggctggtctcgaactcccgaccttaggtgatcctcctgcctcggcctcccaaagtgtttggattacaggtgtgagctactgagcccagcataagtcatatttaaaacaatgggaatgggtaggaacacctagagatagagtgtgggaaatagaatagggtccagtatacagctgtgccaaatttcacatgtacaggttagatagtggagtgggtcagttctgtgggaatgccctgaaagtttgaataatgataagcacgtccattttaacatcatgaggtagtggtgacgttgtaagaggagtttcagtgtagtgggttgtcatgggttaaaacgttcagattgtcatgggttaaaacgtgaattggatatgaggaag

SEQ ID NO: 333545 - DNA, 1018 bp, Homo sapiens
gtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctgctactcctggcctcagggccattccatagtgcccccctgcctcaccacctcctccccgctctcccaggctcttcttgtagaggctctccatccacctccccagtcctgttcccccagcctgggtgcccctaacttgactcttcccatctccccagcataaccaaatctttttttttttttttttttgagacggagtttcactctgtcgcccagactagagtgcaatggctggatctcagctcactgcaaactctgcttactgggttcaagtgattctcctgtctcagcttctgagtagctgggattacagatgcctgccaccacgcccagctaatttttttttttttttttttttttttttgtatttttagtagtgactgggtttcaccatgttggccaggctggtcttgaactcctgacctcaggtgatctgcccatctctgtctcccaaagtgctgggattacgggcgtgagccacccggctcggccgcacaaccaaatcttattaaactcaatctagtctggccctggtgactcacgcctttcggaggcagaggtgggagaatcgcttgagcccagaagtttgagaccagcctgggccacacgacaaagccccatttctacaaaaaaaaaatacaaaaaaaaagccagatgtggtggcatgcacctgtagtttaagctacttgggaggatgaagtgggaggactgcttgagccggggaggtggaggctggagtaaactgagatcgcgccacagaactccagtttgagcaacagatcaagaccctgcctgaaaataaatcaataaatacactcaaccta

SEQ ID NO: 333546 - DNA, 541 bp, Homo sapiens
gtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaagattttgtatcttgttggaaaaatttgagaccagcctgggccacacgacaaagccccatttctacaaaaaaaaaatacaaaaaaaaagccagatgtggtggcatgcacctgtagtttaagctacttgggaggatgaagtgggaggactgcttgagccggggaggtggaggctggagtaaactgagatcgcgccacagaactccagtttgagcaacagatcaagaccctgcctgaaaataaatcaataaatacactcaaccta

SEQ ID NO: 333547 - DNA, 201 bp, Homo sapiens
acatcttggagcccttgcccagagtgtgcaggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaaggtgagacgtggggggctgag

SEQ ID NO: 333548 - DNA, 115 bp, Homo sapiens
atcggcaccgaaaatcaatgaactactactgctatcctaaaaacatgatgactcacaaacaatgctgagtgaaagatgtcatacaaagcagtacatgggtgccgatgaatagcga

SEQ ID NO: 333549 - DNA, 366 bp, Homo sapiens
cggggggcccgggggggcccccttcccccaaaaaaaaaaaaaaaaaaaaaaaaaaaaaaaaaaaaaaaaaaaaagattctaggttttttaagtcagaaagtctcaaaagtcagaggagtgaggagcagtggacttttatgccatgctttcagaaagcaagctctggtctatgaatgaagaagaaaaatgagtggtccaggaaacataacttctagattgttttgtgcaatacttttttccgccatattctggttcctgtatacagtatatctgttcagtatcttaaaaattacaactgttttcatgattttgattgaagatttttttaactcagcccacccacttatggaagtaaagcagaaaggg

SEQ ID NO: 333550 - DNA, 424 bp, Homo sapiens
tcccagctactttggaggctgaggcaggagaatggcgtgaacccgggaggcagaacttacagtgagccgagatcgtgccactccacttcagcctgggtgacagagcgagactccgtctcaaaaaaaaaaaaagattctaggttttttaagtcagaaagtctcaaaagtcagaggagtgaggagcagtggacttttatgccatgctttcagaaagcaagctctggtctatgaatgaagaagaaaaatgagtggtccaggaaacataacttctagattgttttgtgcaatacttttttccgccatattctggttcctgtatacagtatatctgttcagtatcttaaaaattacaactgttttcatgattttgattgaagatttttttaactcagcccacccacttatggaagtaaagcagaaaggg

SEQ ID NO: 333551 - DNA, 533 bp, Homo sapiens
cctgtccctactaaaagtacaaaaaattagccaggtgtggtggtgcgtgcctgtattcccagctactcaggaggctgaggcaggaaaatcgcttgaacctgggagatggatgttgcagtgagctgagatcgcaccactgcaatctagcttgggcaatggagtgagactgtctccaaaaaacaaacaaacaaacaaaaaaacaatagaaattacctgatctgaacaagaaagagaaaataaaaatagactgaaaacaaaattaaaaacagagcctgtggacctgtggaaatactacaaaagatctactatttctgtcctcagggttccaggaggagagaataaagagggccaggttgaaaaggtaatgggtaaaataatggctggatacttgccaactttggcaagaaaaatctatagattcaagaagctgagcaaacactacacagaatacacccatagaaatccatgccacaacacatcacaattaaacttctgaaaataaagagagaagaaatcttgacagcagccagaga

SEQ ID NO: 333552 - DNA, 238 bp, Homo sapiens
agtgggttaggggggcagtgctaaaagtggggaaccagtgtgaattaatctccaacctctatcctttccatcccaccagtctcctgccggggtcctcactgtcctgttcatccagtagtcagaggccagggaggccaccgaggcagactccacaatctttggagggcacaaggctctggagcatgaataaaagattcctggaatggctgggcccggtggctcacgcttgtaatcccag

SEQ ID NO: 333553 - DNA, 178 bp, Homo sapiens
tgcactgttccttcttggatgtgcccgccgtgctgtgcatcttgagaatggcccttcagcgcatcttcatggtttcttcccgcttccgttgttggccctacctcattttacactgtgttaccccttgggaatatcttgcttctgttccttgtctacgcaggtctctaaccctgcaagg

SEQ ID NO: 333554 - DNA, 404 bp, Homo sapiens
aattggactgaagcccgagctactgctgcctatagcttgctctctgtgacgcttttgccgctgagaatgtacctttctggtacagccggagccgagagctctagaaaagaatagtttctgtccatgaaggaacagttcaagaagagcaagcttactctgcccatggaagaccagactcctatctggctttgtttggaacatctaagctcaggaaattcaggtgggtagaaaataccatattggggatcttctcatcactactttcatattgggagacatgaggcaaggatccagctgggtcttatttaagaaagataccaggctggacacggtggctaacacctataatcccagcactttgggaggctaaggcagtgggattccttgaggccaggagttcggag

SEQ ID NO: 333555 - DNA, 114 bp, Homo sapiens
aggtgtgagacagcatgtggacttgtgtgggactcatatccagagtatgtgagggcagcaatgggaagtagaacgtatcgaagggtgaggaaagagccagaaggctgtgtttgt

SEQ ID NO: 333556 - DNA, 534 bp, Homo sapiens
ataatgtgtgtataaatcacctagcataagaaatgtattgtacctgctcaataaatcttactttccttcataaagcagaaaaataattttcaaccacaagtaaaacaaagtggttgttggtcatttagagtttttccttttttaccgctagggtagcatcagtgaagtgagtcaagagacttgggaatactgaggccgttttgcctacagaaaaggcaaaagtgcactcccaatatggaatttatttcttggcaagcagttctctgtctcctatactactcttgcttctatcagtgaaggttctcaccattatatgtcatatattgacaacaacaacaaaaacacagaagattaatgaccaacagtagaaatcaccagtttattgctttaattcaacagcataattttctctgaacagatttagccaacggaagcaaatggtatagtactaggcttaaatctctatgctgactgcatttccctacaatccattgttttatggctctaccctataaccagacagcacaatcacct

SEQ ID NO: 333557 - DNA, 368 bp, Homo sapiens
gatcacaggcacatgccactgcgcccggctaattttttgtatttttggtagagacaaggcttcaccatgttgaccaggctggtctcgaactcctgacctcaagtgatccacctgccttggccatccaaagtgctgggattacaggcgtgagccactgcaccccgccagaacataattttcaaagtctttctcttgaacattaagcttttcataattccgggggataaaaatatgaagtcatgatgacttaagtgcatgatgaaattttccccaaagaggtaattctcaggaggtccagtaccagatgtgagacttccatgtcgttaacagacttccaagtgaaattcccaattgtgcttatttattta

SEQ ID NO: 333558 - DNA, 173 bp, Homo sapiens
tgactcgggatatccatttgtaaaaactgacttctttcatggagtcatgaaggagccaaggagttctagaacatcacactaatttaaaaaaattctaccctacaattttcatgctgatatagctatttcctttccctcactgcctttgaccaacatttatttactgcaaaggc

SEQ ID NO: 333559 - DNA, 415 bp, Homo sapiens
tcaaaatgtggtccgcagacctgcaacattgacatcacccaggattttgttagaaatgcataatctcagactccaccctagacctactgaatccaactgcacttttaaatgatctcgaaatcatttggatacatgtttggcagacactgatctgtactgcacaacactccaaggggacacagttacttagtagggagttggtcctggtatccaggcaagaacagattggagaaaggtttccttggcaaaggagaaatgatggctaccttagatggctctgaggagctttcctgctcatcttcaagacagagtgcaagaaggaagtgaggcacagccttgagaaagacaagaacctcatgctctatgaaagaaacatttaagtagcccttaaatgagaacgtcgacgcatcaactt

SEQ ID NO: 333560 - DNA, 1500 bp, Homo sapiens
ggggaagggacgggagggaagggggaggggaaggggaacgcgggagagggaagggggcggagctagccggagccgcgagtccattttggggctgtgcttggcgcgtaccgtgcggtccctgtagttggaggacgggcggtcgcgcggcctttcccactagccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgt

SEQ ID NO: 333561 - DNA, 910 bp, Homo sapiens
agcggagacgccggaaggaacgcggtctcaccacccggctccctccgccaaggcgaggcgcggccggggaggcgggacacaggcgaagcgggacggggaggcggggccggagtagcctctagttcgttagtcaaaacgtgaaaaaaaagacctgctttgccctgggaaatagtaaccctgccaaatacatcagcttgtaggagacagaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtatttt

SEQ ID NO: 333562 - DNA, 1206 bp, Homo sapiens
ggggaagggacgggagggaagggggaggggaaggggaacgcgggagagggaagggggcggagctagccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccaggtcagcagggatctgcgtgggttgggggggctggcgaaggccgtctgagctccagtccggcagcgcggcagaaaccagcggggcactgtcatgggcctggggaggagcggcctgcggagggcgccggggcagtgtgtctgtggtccagaaaacctgctccgtccggagccttcctggccccgctaccagcgtctccacatcccctagaaaagaaaagacgggtgtgggccttaggttacagcgcgccgccagcgtttggttgcatggcgccgggggagggcgccctaaccgagaagctgcttaatacaaagagctccaggctcctggcggttcaccaggtctaaacagccgggctttatttgtgggggcgattgaaaaaattgagggtcaagattggggtgctgtgcaaataaatgcgttaatactgttctttttcttctttctttgcagtagcctctagttcgttagtcaaaacgtgaaaaaaaagacctgctttgccctgggaaatagtaaccctgccaaatacatcagcttgtaggagacagaggtaaactacaataattttcctgtgttatctttttttttttaaacacccaatttcaataggccctagaaccttccaaaatggaactgtgtgtagaatacgtatgttcccatccactttcattggtggtctttgttctttgcatattttgttaaaacttagaaaaacagaattcacgtttagcaattatttatgtggtatttatcttaaatatagccaaacattcatattacaaaggaagaaaggggcttccacacttttttcctacttttttttcccttctcctatgcttagtgaattgtcaggctgctagggcttgtagaacagggcttgagttttctagagacctttatataataggcactttaaaagcagaatttcatttacataggcactccttctagtagaact

SEQ ID NO: 333563 - DNA, 423 bp, Homo sapiens
catgagacctatcctctacacagatttctaagtgtacagtacagtggtgttaactatagacatgagcagatctctgaaacttacttttatgtgtcttttataaactatttatcataccttctagaataacagcacctggccgggtgcagtggctcaggcctgtaatcgcagcactttgggaggctgaggtgggcggatcacctgaggtcaggagctcgagaccagcctggccaaaatggtaaaaccctgtctctactaaaaatacaaaaaattagctgggcatggtggcaagtgcctgtaataccagctacttgggaggctaaggcaggagaatcacttgaacccaggaggcggaggttccagtgagccaagatcacaccattgcactccagcctgggtgacaagagcaaaactctgtcccaa

SEQ ID NO: 333564 - DNA, 1117 bp, Homo sapiens
tgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctcctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagac

SEQ ID NO: 333565 - DNA, 1521 bp, Homo sapiens
ccaacccataggctaggtcgaggcctcgtgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgt

SEQ ID NO: 333566 - DNA, 1446 bp, Homo sapiens
agcggagacgccggaaggaacgcggtctcaccacccggctccctccgccaaggcgaggcgcggccggggaggcgggacacaggcgaagcgggacggggaggcggggccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgt

SEQ ID NO: 333567 - DNA, 2035 bp, Homo sapiens
ggggaagggacgggagggaagggggaggggaaggggaacgcgggagagggaagggggcggagctagccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccaggtcagcagggatctgcgtgggttgggggggctggcgaaggccgtctgagctccagtccggcagcgcggcagaaaccagcggggcactgtcatgggcctggggaggagcggcctgcggagggcgccggggcagtgtgtctgtggtccagaaaacctgctccgtccggagccttcctggccccgctaccagcgtctccacatcccctagaaaagaaaagacgggtgtgggccttaggttacagcgcgccgccagcgtttggttgcatggcgccgggggagggcgccctaaccgagaagctgcttaatacaaagagctccaggctcctggcggttcaccaggtctaaacagccgggctttatttgtgggggcgattgaaaaaattgagggtcaagattggggtgctgtgcaaataaatgcgttaatactgttctttttcttctttctttgcagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgt

SEQ ID NO: 333568 - DNA, 2701 bp, Homo sapiens
agcggacttctcccaagatcgtaaatttggaggagccattccttcatcatccatgttgcatccttcacaaccgttcaacggtttaagtgcttatagcctctagttcgttagtcaaaacgtgaaaaaaaagacctgctttgccctgggaaatagtaaccctgccaaatacatcagcttgtaggagacagagaataacagcacctggccgggtgcagtggctcaggcctgtaatcgcagcactttgggaggctgaggtgggcggatcacctgaggtcaggagctcgagaccagcctggccaaaatggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttgagatggagtcttgctctgtcgcccaggctggagtgcagtggtgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaa

SEQ ID NO: 333569 - DNA, 1499 bp, Homo sapiens
ggggaagggacgggagggaagggggaggggaaggggaacgcgggagagggaagggggcggagctagccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccaggtcagcagggatctgcgtgggttgggggggctggcgaaggccgtctgagctccagtccggcagcgcggcagaaaccagcggggcactgtcatgggcctggggaggagcggcctgcggagggcgccggggcagtgtgtctgtggtccagaaaacctgctccgtccggagccttcctggccccgctaccagcgtctccacatcccctagaaaagaaaagacgggtgtgggccttaggttacagcgcgccgccagcgtttggttgcatggcgccgggggagggcgccctaaccgagaagctgcttaatacaaagagctccaggctcctggcggttcaccaggtctaaacagccgggctttatttgtgggggcgattgaaaaaattgagggtcaagattggggtgctgtgcaaataaatgcgttaatactgttctttttcttctttctttgcagtagcctctagttcgttagtcaaaacgtgaaaaaaaagacctgctttgccctgggaaatagtaaccctgccaaatacatcagcttgtaggagacagaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtatttt

SEQ ID NO: 333570 - DNA, 1330 bp, Homo sapiens
tgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtatttt

SEQ ID NO: 333571 - DNA, 964 bp, Homo sapiens
ggggaagggacgggagggaagggggaggggaaggggaacgcgggagagggaagggggcggagctagccggagccgcgagtccattttggggctgtgcttggcgcgtaccgtgcggtccctgtagttggaggacgggcggtcgcgcggcctttcccactagccggagtagcctctagttcgttagtcaaaacgtgaaaaaaaagacctgctttgccctgggaaatagtaaccctgccaaatacatcagcttgtaggagacagaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtatttt

SEQ ID NO: 333572 - DNA, 1058 bp, Homo sapiens
ggggaagggacgggagggaagggggaggggaaggggaacgcgggagagggaagggggcggagctagccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccaggtcagcagggatctgcgtgggttgggggggctggcgaaggccgtctgagctccagtccggcagcgcggcagaaaccagcggggcactgtcatgggcctggggaggagcggcctgcggagggcgccggggcagtgtgtctgtggtccagaaaacctgctccgtccggagccttcctggccccgctaccagcgtctccacatcccctagaaaagaaaagacgggtgtgggccttaggttacagcgcgccgccagcgtttggttgcatggcgccgggggagggcgccctaaccgagaagctgcttaatacaaagagctccaggctcctggcggttcaccaggtctaaacagccgggctttatttgtgggggcgattgaaaaaattgagggtcaagattggggtgctgtgcaaataaatgcgttaatactgttctttttcttctttctttgcagtagcctctagttcgttagtcaaaacgtgaaaaaaaagacctgctttgccctgggaaatagtaaccctgccaaatacatcagcttgtaggagacagaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctctttta

SEQ ID NO: 333573 - DNA, 523 bp, Homo sapiens
ggggaagggacgggagggaagggggaggggaaggggaacgcgggagagggaagggggcggagctagccggagccgcgagtccattttggggctgtgcttggcgcgtaccgtgcggtccctgtagttggaggacgggcggtcgcgcggcctttcccactagccggagtagcctctagttcgttagtcaaaacgtgaaaaaaaagacctgctttgccctgggaaatagtaaccctgccaaatacatcagcttgtaggagacagaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctctttta

SEQ ID NO: 333574 - DNA, 2660 bp, Homo sapiens
ggggaagggacgggagggaagggggaggggaaggggaacgcgggagagggaagggggcggagctagccggagccgcgagtccattttggggctgtgcttggcgcgtaccgtgcggtccctgtagttggaggacgggcggtcgcgcggcctttcccactagccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttgagatggagtcttgctctgtcgcccaggctggagtgcagtggtgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaa

SEQ ID NO: 333575 - DNA, 1428 bp, Homo sapiens
tgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggctggtatgcaatggcgtgatctcggctcaccacaacctccgcctctggggttcaagtgattctcctgcctcagcctcccgagtagctgggattacaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtatttt

SEQ ID NO: 333576 - DNA, 1904 bp, Homo sapiens
cacgctgaagacattcctgtcttgtgaagcaagtctgtttgtattttaagtttgccaggactaatgaattaaaacatttggactccccacaacttgctgtttatcaatgcctctgacaggaggagggttttcttttgctcttgctttttctagaaagatgacaacatcctggctgttagagaggcaaggaaaggagagaggggttgtgaagggaagcggaagggaagggaagggaggtcccgtgggacgctggggtctggggcagagcaggtagcagcgtgctgccctgacagctgtctccgctcctcagattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctctgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 333577 - DNA, 2102 bp, Homo sapiens
ctctccctccacacctccccgcaagctgagggagccggctccggcctcggccagcccaggaaggcgctcccacagcgcagtggtgggctgaagggctcctcaagtgccgccaaagtgggagcccaggcagaggaggcgccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctctgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 333578 - DNA, 770 bp, Homo sapiens
ctctccctccacacctccccgcaagctgagggagccggctccggcctcggccagcccaggaaggcgctcccacagcgcagtggtgggctgaagggctcctcaagtgccgccaaagtgggagcccaggcagaggaggcgccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggggtctcgctatgttgcccaggctggtctggaactcctgagctcaagagatcctccctcctccgcctctcaaagtgctgggattacaggcatgagccaccgtgcctggctgaaattgaattgattctatgacct

SEQ ID NO: 333579 - DNA, 1509 bp, Homo sapiens
gaaggcagccactgtttaaaagtaaacacaccacacatcaacttggggcagcttgtaagcagcttcgcaagccctgaaacttctggctggtagggatgccagctaaaccagatggcatcaaacagtgaaatacaggcctggctttcagacttgatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctctgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 333580 - DNA, 1520 bp, Homo sapiens
ttgtgcacctgtttggtttctggaaagtgctccctcatgttaaatttatgtagttaagttgtaaaacaggaaatcttccttgaccctttgcaggatttgtgaaaggggtggcttgtttactgagcccgcagcactcaatcccttacgggatggggaacatgcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctctgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 333581 - DNA, 1248 bp, Homo sapiens
cacgctgaagacattcctgtcttgtgaagcaagtctgtttgtattttaagtttgccaggactaatgaattaaaacatttggactccccacaacttgctgtttatcaatgcctctgacaggaggagggttttcttttgctcttgctttttctagaaagatgacaacatcctggctgttagagaggcaaggaaaggagagaggggttgtgaagggaagcggaagggaagggaagggaggtcccgtgggacgctggggtctggggcagagcaggtagcagcgtgctgccctgacagctgtctccgctcctcagattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 333582 - DNA, 1993 bp, Homo sapiens
ctctccctccacacctccccgcaagctgagggagccggctccggcctcggccagcccaggaaggcgctcccacagcgcagtggtgggctgaagggctcctcaagtgccgccaaagtgggagcccaggcagaggaggcgccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctctgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 333583 - DNA, 2231 bp, Homo sapiens
ctctccctccacacctccccgcaagctgagggagccggctccggcctcggccagcccaggaaggcgctcccacagcgcagtggtgggctgaagggctcctcaagtgccgccaaagtgggagcccaggcagaggaggcgccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctctgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 333584 - DNA, 1572 bp, Homo sapiens
cacgctgaagacattcctgtcttgtgaagcaagtctgtttgtattttaagtttgccaggactaatgaattaaaacatttggactccccacaacttgctgtttatcaatgcctctgacaggaggagggttttcttttgctcttgctttttctagaaagatgacaacatcctggctgttagagaggcaaggaaaggagagaggggttgtgaagggaagcggaagggaagggaagggaggtcccgtgggacgctggggtctggggcagagcaggtagcagcgtgctgccctgacagctgtctccgctcctcagattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctctgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgc

SEQ ID NO: 333585 - DNA, 1555 bp, Homo sapiens
gatcagcagcaacttaaccaaagctctgttacagcctgtagccaagagaaggaacctgtggttcgtttccccagacggtgtgatgaaaagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctctgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 333586 - DNA, 1641 bp, Homo sapiens
ctctccctccacacctccccgcaagctgagggagccggctccggcctcggccagcccaggaaggcgctcccacagcgcagtggtgggctgaagggctcctcaagtgccgccaaagtgggagcccaggcagaggaggcgccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctgggttgacattcgtaaccttcctggatcctatcagagaaaccttgttcatcatttcatttccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctctgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 333587 - DNA, 673 bp, Homo sapiens
tctagctgagagcgtcggtgtgggcccgaaatcccccgaatcccgtggaccctgcgaggccggggctccaggcgtcgggcacctctggacagtgtcgcggggcttgcggcgccgaagccgcgtgtctccgaacggacggtagatggcagcagaccgcataatttgggtcacagcgaactgtctaagggaggatttataaccctccaagactacaggagaaaaagacctttagtatgggtgggtttgggaaatttttcccttgagaatagtccccgagtgccgtgggtgctggcggagaactctagctacgaagcccagcggtccctccaggcgcccaggccgggcctgaacctagggcatctacctggggccacagagccgcctcttccgcgccacaagtggcagcgtcgtccctctcctagcttaggactgagataataaatatatccccacttccaaaacgccccagaccctgtaactccggggcaaccagaggcccgaggctgaatgtcctgcatctggtcttaagaaagagaaaagcaatcacatgttcgtgcaaaccagactaaaaatcacaatttctcctgccctccacagccaacatcacttatctcttggctggaagcttccccagaagctcccttaccccatttttaagtcctgcctcaagctg

SEQ ID NO: 333588 - DNA, 409 bp, Homo sapiens
aatgcgtcacactagctaatttagtagctttaggtggacacgcagacataccctacagaaatattgggttcatactccattctggtggagtcacatgtttagaagttcacatgtggtctctgttggcggcccgtcatggcaaatggtgagtgccatgtggctggggaagagatgctgctgtgttcaaggagccggcatgtgtgttgccactggagtttcgtacttgagagatgagtttgctgtttttttagaaatcagctccacaatcagagatagttttaatgcccttgaattattttgtgatttagctcgtactatttatcacatcttttggatttgaagttttaaaaaatgggcagtttgatcaagtatggtgtagatagaataaaccaaaggttccctgtgaaag

SEQ ID NO: 333589 - DNA, 820 bp, Homo sapiens
  misc_feature (774)..(774): n is a, c, g, or t
ttgcgttgttccacacaccttccatataagataataaaatcaactaggaacaagagcattgaccaagttattatcttcaactctctcaaagggtgaagagagaaaagcaacactgagtcaactggctggtttttcatccctttctcttcttcagttgtgggctggagagagatgtaattccaggacattggccagccttttgttatgtggatacgctttacacaactacagtttatccatcagaatgaaatacagacaaaagctgaggaaatcagtcttcttaatagatagaaagtgatcctttctgcctccaaataaaactgaattataacattcttcgtatttctctgggtacacatctggtttaaaaattagaagttaaattttaaaagtaggcagaagtttgtatttagagaaagacattttaactgtaatagtgatcattattttaatgcttataaagtccaatcaaagataaatgtcaaaccataactgaatatattgtgtgctgtgtgagagatgaaatacatagagaaaatccactttaaatggtaaaaaaaaagaaaaaatatattatggcttttttctagggaatattctgtaaagagaatggcaaagctgtgcattgaagagccaacttcaaaaaggtgaataaatagtggaatattaaaaggaaggaatgcgggctcattggactcataggagaagctctggaagcgattggccttaaagaggggaaatagctgatgcttggtaactgactgagctcactgnggcgcgtagatgcaatccagccgcgcccagaaccaaaagtgcataa

SEQ ID NO: 333590 - DNA, 668 bp, Homo sapiens
ttgcgttgttccacacaccttccatataagataataaaatcaactaggaacaagagcattgaccaagttattatcttcaactctctcaaagggtgaagagagaaaagcaacactgagtcaactggctggtttttcatccctttctcttcttcagttgtgggctggagagagatgtaattccaggacattggccagccttttgttatgtggatacgctttacacaactacagtttatccatcagaatgaaatacagacaaaagctgaggaaatcagtcttcttaatagatagaaagtgatcctttctgcctccaaataaaactgaattataacattcttcgtatttctctgggtacacatctggtttaaaaattagaagttaaattttaaaagtaggcagaagtttgtatttagagaaagacattttaactgtaatagtgatcattattttaatgcttataaagtccaatcaaagataaatgtcaaaccataactgaatatattgtgtgctgtgtgagagatgaaatacatagagaaaatccactttaaatggtaaaaaaaaagaaaaaatatattatggcttttttctagggaatattctgtaaagagaatggcaaagctgtgcattgaagagccaacttcaaaaaggtgaataaatagtggaatatt

SEQ ID NO: 333591 - DNA, 3367 bp, Homo sapiens
cagcagcctcctctttcctgactgtcacatttcttttccagctctgaccgggagtcagctcctcggggataccatcccccgacctcaccttctacctaccgcagcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagttggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgccccctgcactgcaggtctggggactgggcctaatcagtcagacccaagaggagggggtggctttggccctattctagaacatcaggacacagagctccaggctgaacacattccagggtcaggagctggtcctggatgctcaggggcccctctcttctcctggcccaggagacgtgtcctgtgagggcggagccgctgctgctggttcgcatcaatgcctctgggggcctcatccttaggatgggggccatcaaccgctgcctgaagcaccctctggccagggacaccccagtctgcctcctcgctgtcctgggggagcagcactcagggaagtccttcctcctcaaccatttgcttcagggcttgccgggcctggagtctggtgagggcggccggccaagaggaggagaggcatccctgcagggctgcaggtggggcgccaatggcctcgccaggggcatatggatgtggagccaccccttcttgctggggaaagaagggaagaaggtggcggtgttcctggtggacacaggggatgccatgagccctgagctgagcagggaaacaaggatcaagctctgtgctctcaccacgatgctgagctcctaccagatcctcagcacctcccaggagctgaaggatacagacctggactatctggagatgtttgtccacgtggccgaggtgatgggcaagcattatgggatggtgccaatccagcatctggacctcttagttcgtgactcatcccaccccaacaaggcagggcaggggcatgtaggcaacatcttccagagattgtctggcagataccccaaggtgcaggagctgctgcaagggaagcgagcccgttgctgcctcttgcctgccccagggaggcggcggatgaaccaaggccatgcaagccctggtggtgacacagatgatgacttccgccaccttctgggggcctacgtctcagatgtgctgagtgcggccccccagcacgctaagagccgctgccaggggtactggaacgaggggcgcgccgtggccaggggggacagacgcctactcacggggcagcagctagctcaggaaatcaagaacctctcaggatggatggggaggacagggcccggtttcacctctccggatgagatggctgctcagctgcacgacctgaggaaggtggaagctgccaagagggagttcgaggagtatgtgaggcagcaggacgtagccaccaagcgcatattctctgcgctgcgggtcctgccagacaccatgcggaacctcctctccacccagaaagatgccattctggcccgccatggtgtggccttactctgcaaggggagagatcagaccttggaggcactggaagctgagctgcaggccacggccaaggccttcatggactcctacacgatgcgcttctgtggccacctagctgctgtggggggtgctgtgggggccgggctcatgggcctggcagggggcgtggtgggtgctggcatggcagcagctgcactggctgcagaggctgggatggtggctgctggagctgccgtgggggccacaggggccgctgtggttgggggtggcgtgggtgctgggttggctgccacagtgggctgcatggagaaggaggaggatgagaggcttctggaaggggaccgagagccccttctccaggaagagtaacagccccaggaggtattgaaggacaggagagatgtcaggtggggatgaagaagaggggcaggtcgggggagggtgatgccagggattccaaggcaccgccatgtactgcactgccctggtcgaatgctcggtgtctgggtggcagctgagctgggactcaaggtggctcttggaacctgggaggcagcatctgggggcagtggatagaacacccggcctgtttctggttgcagatggttgccgatctgcccttgtcacagataggctacatcccagggtttctggctgcaagtgagactccaccctccccacctggctcatttccccgatgaccctggattgtaggaaagttaagcaggcaccatcctggaagtctacccctaggtggtcgagagacctgttctttcacagatgtgagaagccccaggatgattgaccatggtgttcaggagcggggagcactgatgaggtgctggggatgacaggaaggaaggaacactgggcagaaccagagagatgggacatggtagactgtggcccagaccccagagcagagaaacttgttcccatgacccttcccaaatctgctccagcaggactaaggtggctttcccactcctggcccacagccccagagagcctgtctgtgcatcctgaaccactctttgctgggcctccgcaagggcctctcttgggtctgtgtcctttttcaagcctgtttagatgggggagtgcccatgccctctgtgaagtgcccaaatgcgaaagaataacaccttttcttgcattctgagctaagccagacagcctttatactagattctatcaaaatcttgcaaaggaaaacaaaatgaacaacttctacccttaaacacatcctttctcccctgggcttgtaagaagatgcagcttgatgcagctcctcaaacaccaggccccctgggaactgggggtgcgggagttctccctctgggggacagaaaatctgactactaggaagacttctaggctatgaaactgacttctaggctatgaaacttacagggtatgggtgggcacattatcctttattttatgaaaaataaaatgtgtgtatgtgaaaaaaaaaaac

SEQ ID NO: 333592 - DNA, 3213 bp, Homo sapiens
cagcagcctcctctttcctgactgtcacatttcttttccagctctgaccgggagtcagctcctcggggataccatcccccgacctcaccttctacctaccgcagcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagttggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgccccctgcactgcaggagacgtgtcctgtgagggcggagccgctgctgctggttcgcatcaatgcctctgggggcctcatccttaggatgggggccatcaaccgctgcctgaagcaccctctggccagggacaccccagtctgcctcctcgctgtcctgggggagcagcactcagggaagtccttcctcctcaaccatttgcttcagggcttgccgggcctggagtctggtgagggcggccggccaagaggaggagaggcatccctgcagggctgcaggtggggcgccaatggcctcgccaggggcatatggatgtggagccaccccttcttgctggggaaagaagggaagaaggtggcggtgttcctggtggacacaggggatgccatgagccctgagctgagcagggaaacaaggatcaagctctgtgctctcaccacgatgctgagctcctaccagatcctcagcacctcccaggagctgaaggatacagacctggactatctggagatgtttgtccacgtggccgaggtgatgggcaagcattatgggatggtgccaatccagcatctggacctcttagttcgtgactcatcccaccccaacaaggcagggcaggggcatgtaggcaacatcttccagagattgtctggcagataccccaaggtgcaggagctgctgcaagggaagcgagcccgttgctgcctcttgcctgccccagggaggcggcggatgaaccaaggccatgcaagccctggtggtgacacagatgatgacttccgccaccttctgggggcctacgtctcagatgtgctgagtgcggccccccagcacgctaagagccgctgccaggggtactggaacgaggggcgcgccgtggccaggggggacagacgcctactcacggggcagcagctagctcaggaaatcaagaacctctcaggatggatggggaggacagggcccggtttcacctctccggatgagatggctgctcagctgcacgacctgaggaaggtggaagctgccaagagggagttcgaggagtatgtgaggcagcaggacgtagccaccaagcgcatattctctgcgctgcgggtcctgccagacaccatgcggaacctcctctccacccagaaagatgccattctggcccgccatggtgtggccttactctgcaaggggagagatcagaccttggaggcactggaagctgagctgcaggccacggccaaggccttcatggactcctacacgatgcgcttctgtggccacctagctgctgtggggggtgctgtgggggccgggctcatgggcctggcagggggcgtggtgggtgctggcatggcagcagctgcactggctgcagaggctgggatggtggctgctggagctgccgtgggggccacaggggccgctgtggttgggggtggcgtgggtgctgggttggctgccacagtgggctgcatggagaaggaggaggatgagaggcttctggaaggggaccgagagccccttctccaggaagagtaacagccccaggaggtattgaaggacaggagagatgtcaggtggggatgaagaagaggggcaggtcgggggagggtgatgccagggattccaaggcaccgccatgtactgcactgccctggtcgaatgctcggtgtctgggtggcagctgagctgggactcaaggtggctcttggaacctgggaggcagcatctgggggcagtggatagaacacccggcctgtttctggttgcagatggttgccgatctgcccttgtcacagataggctacatcccagggtttctggctgcaagtgagactccaccctccccacctggctcatttccccgatgaccctggattgtaggaaagttaagcaggcaccatcctggaagtctacccctaggtggtcgagagacctgttctttcacagatgtgagaagccccaggatgattgaccatggtgttcaggagcggggagcactgatgaggtgctggggatgacaggaaggaaggaacactgggcagaaccagagagatgggacatggtagactgtggcccagaccccagagcagagaaacttgttcccatgacccttcccaaatctgctccagcaggactaaggtggctttcccactcctggcccacagccccagagagcctgtctgtgcatcctgaaccactctttgctgggcctccgcaagggcctctcttgggtctgtgtcctttttcaagcctgtttagatgggggagtgcccatgccctctgtgaagtgcccaaatgcgaaagaataacaccttttcttgcattctgagctaagccagacagcctttatactagattctatcaaaatcttgcaaaggaaaacaaaatgaacaacttctacccttaaacacatcctttctcccctgggcttgtaagaagatgcagcttgatgcagctcctcaaacaccaggccccctgggaactgggggtgcgggagttctccctctgggggacagaaaatctgactactaggaagacttctaggctatgaaactgacttctaggctatgaaacttacagggtatgggtgggcacattatcctttattttatgaaaaataaaatgtgtgtatgtgaaaaaaaaaaac

SEQ ID NO: 333593 - DNA, 811 bp, Homo sapiens
  misc_feature (804)..(806): n is a, c, g, or t
  misc_feature (808)..(811): n is a, c, g, or t
gtgaattagccaatttgtaaatacctttttataagtgatagaaaagatgcatcttggacatggaattgttaaaccgcctctgagcagtatatgtcaggacttgttcattaggttggcagcagaggggcagaaggaagtatacagggagagatgtatgcagatgtgtccatatgtgtccatatttacattttgatgatagccattgatgtatgcatctcttttggctgtactataggaatacattaagtaattcaatggaaatataccttgctaatattataatggtatagctctgttaatgaattctcttagaaacattatacttaatgtattctgttgctgtatgtttcattttaattgagcattaagggaatgcagcatttaaatcagaactctgccaatgcttttatctagaggcgtgttgtcatttttgtcttctatgaaatttttgtcccaagaaaggtaggactacatttttttttaacagattaagttggtgtagtgtattcttgtttatcaaaatactaataaagctttgggattttgaattggtaaatattcatgatgtgtcaaaaatcatgatacatactgtacaatctcagtcccataagatgggatgttgtgcctacacacacacaggacctagaagaacatgtcaaactgtaaactgcttgtgattgtgaatgactttgttgtttgcttcttgtgattttcagtttcctataatgcacatattaacatattaactttttaaaataaaggttattttaaaagcctgtttaaaaaaaaaaatcactggaaaannnannnn

SEQ ID NO: 333594 - DNA, 473 bp, Homo sapiens
aatcaaatggagggacccaaatctgaaaagatggtaagaggaagtgatctgaattggaggaggaggatttagattagcttttgaggaaacttcctcatgcctgtgaggttcttcagggggcgactgaaggagatcagagctctcaaaggatggggcagaaaaattcaatttcagcttgaggaagaagcctatgatcagaatcagaggaagggattgggtttggacaaatcatatacactgttggcttgaaaacgttggtgtgtgcttcctgtcttgagctgtctgctaatggtacctactttttcggcatcagaacaagttgtactcctgcacaaagagatcagagaacttgttagcaatgggggagagtggctatcccattgcagaaacaagaatgcctgttagagctgaaagtagggccaggtgtctactccctgctttgctcctgagcaccttggtctatgacttgagcg

SEQ ID NO: 333595 - DNA, 467 bp, Homo sapiens
acagacttctccttagaaggactgtgccaaaacagtcctgaatgttcgtgttggccttaatgaaccaccccttagtgactcagtcaccattctccacaagccctacagccatcccggctccctctcttctagcaaataggttcggggtaaaaaagaagaaatttattaggtatgaattccctccttttcctgccacattcccttcagtatcttaggataatgtatacatttcaggcttattcaccagtttgtacttctgattacattttctcatttcatccactttcagattttccttcttattacctttcttccctcctaaacctctagcctctccccatctttccttactggcttctgtggcctacacactttttcattctgacaaccttcctctaacttcgcatctcctggtaactttattaccaaatcatgtatactcattgtgatcttccactttcctcctc

SEQ ID NO: 333596 - DNA, 402 bp, Homo sapiens
ggtgactatagtcaataagaacttaattatgcattttaaaataactaaaagagtataatttgattatctgtaatacaaaggagaaatgtgtgaggtgatggatacccccatttaccctgatgcgattattacacattgcatgcctgtatccaaatatctcacaaacctcataaatacatacacctactatgtacccaccaaaataaaacataattatattatataaagttgctaaataattagaactgtacccaaatataaataataaataattgatgaacaagataaaaagtgaaaacacacttgttttctacacgcaatgtatattcccttaataacttttggtgagtaaatagacatggcaatgtcttctttagcatcatggatagtgaaataatcttg

SEQ ID NO: 333597 - DNA, 286 bp, Homo sapiens
gaaatcagctcctatcaacaatgctgtctctccctatgcctgagacaaagggcctttatcagatggcacggtgaataggcagggccttctctcaaaactgccaagtctgtttatgtatctattatttcctttgaaaattgcctgaagtggagccttgtgaagaatttctcaagcattgcctcaaaccattgccaaggttgggttgtaatggaagtgcagaaagaacaaaggacaggcaccagaatgttcttttattgcttgcatgacaaagaggaaagaaaaagag

SEQ ID NO: 333598 - DNA, 526 bp, Homo sapiens
tgagccgagattgtgccactgcactccagcctaggcgacaaagtgagaccccaactcaaaaaaacaaaacaaaaaaatagaataaaagacgtgctgttagttatcagtagcacaggggcccggtgacaccgggcctgtatgccaggttgtaagtctaacagtcacaagaagctggaaggtgtcaatctgggcgatgactttatttatgttaaaataaattattctgactgccagccaggcacggtggctcacgcctctaatcccagtgctttgggaggctgaggcaggtggatcacctgaggtcaggagttcgagaccagcctggccagcatggtgaaactgtatgtctactaaaaataaaaaaaattagttgggcatggtgacaggtgcctataatcccagccatttgggagactgaggcaggtgaatcgcttgaactcaggaggcagaggttgcagtgagccaagagcgctccactgcattctagcctgggcgacagagtgagactccatctcaaaaaaagaca

SEQ ID NO: 333599 - DNA, 595 bp, Homo sapiens
tctactatccagcacagttctatgaattgagtaagccagacatttcaatgttcatagtttttaatgggaagctgaggcttgccccagatcaagcagcttgtaagtggtcaccccaaaacctatgcccaagcttaccacaggacttatcacactgctttgtgacaatttgagcaacctgaatttcctctacactgggagcaacttgaaggccagaactattacatgcggaggaggtaatgagcatccttagtgcccacaggggacagtaaatgttgaagtagaaggccctacagagctaggggttgaacaggggcccataaaatcacttaagggttgaaggatataacgtcaatgtccctcatggggctgaggaatctcaatgacatcaccctaattgggctggggacaaggacaacatcacacacagagctgagtgagataatgacattgctgcctacagagtgaggcaattataggtcattcatggagtcagaggaccaaatatatcacgcccacggggcagggagaacaatgacaacattacccacagaattgaagagtgacaatgacattcccacaggtgggggttgggggg

SEQ ID NO: 333600 - DNA, 363 bp, Homo sapiens
ccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccata

SEQ ID NO: 333601 - DNA, 734 bp, Homo sapiens
ggccttcctgggcttgtagacatctcactccaggctcagccttcctcttcacgtggccttctctctgcatctgtgtcttctaaagatgccagttattagattctgggcccaccctaatccagtgtgtttgtatctcaatcatgaactaattgcatctataatgcccttatgtccaaataaagtcatatgctgaggttctatgtagggttaaaaaactcttccatgatacttgttaaagtacagtaaggaagagttcactgaggaccattgagataggcacagggatcacagcaataggatttgcagtgggagaaagagattgggctccactctgaacacagcccaggcaggggaggatttatagccaaagagcagggcggggtccatggatggaaaactgctaagaggaaacattagaggtaagggggattctggctaaacccacctaataggattcttgctcaaggcaggccagggtgaccagatattgctggggcatgatggagagtgaggaactccatcagacatagttgaggtggtcagatatcaaggtgtagggggcttttgttaaactgacacagcatggttctttgctaaaactggattttacaagaaagtgtacagaggggcctaggagatggttcggggacctggctaaagtttggtcaagcaaagaatctatgtcggtggacatgaatttgagagggacattacattaatccactacagggagc

SEQ ID NO: 333602 - DNA, 363 bp, Homo sapiens
gcacctgtctaaaggctggtgacgcagaagtgaatgaagcaaaattcttgcttttatggagtttggctaatagaggatgagagcagtcataacaaaccaacaaatcaataaataatttcagagggtaatagtgccgtgaagaaaaatcagctctctgtgaggagagtgactggcatagggggaaggccactttacaggaacctggcaggtagagcccctgagtgatgacatcaagctgagccctatgcgatggagccagtgagccatgcagcgatctattggagggcattttacctgcagagtccatcagagcaaaggtcaaggactcgaaagagcttggcttgttttaggaacagagagaaa

SEQ ID NO: 333603 - DNA, 1782 bp, Homo sapiens
tgccagtgataacctgagagctggcaagaaagttttaactgttacaagaactcagtttaacataaaatttaaacagtaggtcaaagcaaatattgcagtctcaatcttcagagagtcatttagtaatttgagagttgtcacaaagattctttgcttgaccaacccgtaggcaagcccttaaaccttctcctaggcctagctgtgtaaaatccaattttagcacaaaccctgtaaaaccagtttagcaagaactcttcctcattgtagaccattcccaggtgatgtctgatcaccctggcctgtcttcagcaagaatcctgttagggtttagccagagtcttccttactctggatgttattttttagtaatttcacatccactgagtgggatgaaagcaaacccaccttgctccttggctatacttgcccttgctgtttccctactgtctctccctcactgagtcgaacccagtctctctccccagctgcaacatcacattgccgtggtccctatatctattgagatgatcctgaataacgtctaccttaccatgctttaacaagtatcactgagtaattttttatttaacagttacggtgctgtgactccgataggatcagattcatcattggacccccagacctctcacccaggaccccaagtgtgcacctttgaagccattgtcttcactcctgactgatagatcggggatccaatggtgagtcagactaacgaaccattgctccggacaaacatctgttgaagctggtaaggaaagatttcgattctcaagattgtgaatatattctctggagttgggctagaggccagacttcttttgaaaggtacctcctgggcttgaaggtcttcttcctggctctctttcctgagtggggtttattccctgactccctggactaaaagtccttggaactctgtgaggctactctgttgtctctaatggatcctacttctcccatggcaatttctctggcatctgaatcccctctgtttgagcccctgctaactatattgctccaccactggttctgtccacctcctccttgttggacctttattggcctgtttggaatacttaagatctccccagactgcatcctgtaagctgtctttcttcccattgctactgctccttattcctcctcttaccacctttaatgttccttccagttcccttgagccctttgatatgactcccttcaaattcttacatcctccatccatctgtccacccactgctagactttttccttctcattctggactctttgtcactgggactgtaggccccccacccttcctggggatctctcaggggacttggggactcccaaaagtaatgacttgggttgaaaaggaaaaagaacaattggaaatagcctaagtattttatctacactcagatgggctttggagatatccagacagcccctagatgtctcttcagcctccatgagattacacatcatggcaaaataaaagtctttttttttttttgagatggagtctccctctgtcacataggctggagtgcagtggcacgatctcagctcactgcagcctctgccttccgggttcaagcagttctgcctcagcctcctgaatagctgggattacaggcacccaccaccacacccagctaatttttgtatctttagaaaagaggagtgacctcatccaatttatgttttcttaggtataatataagctggactcaaaagacctgggcccatatcctaactctaccatttattttagac

SEQ ID NO: 333604 - DNA, 388 bp, Homo sapiens
tcatcgatatagccgggtcgagtctagagaaccccccttatgttctgacccacccaagtggctacttcaatggttggttgataataactttcaacattctgtgaatgtaagctgtgcacaccctgaatggctagcagggcaaagcatcctgaatgtggatctgaaagattttgtctgtggtttgtatttttgttttaaaattttatatattacacacttataatcttaacagaattaaaaaaattaaaccagaatggttttccactaggaatttttgtaatcatacagttttaattgccattaaaaatgatcacaggcattttaatgaatgaaggcttttctcttttagagggactgttaaccttaggttaggtatttggtagtcaga

SEQ ID NO: 333605 - DNA, 4003 bp, Homo sapiens
atgtctggtcccaggtctggtgaggagaaatcccgtattttggagaacctacatctaatattactctactttcattagtccataatataatcccagaaataaatgcacaggcactccagttttaccctgctctggagagtttagacctcagctcaaatataatatcagaaatcaagacatcttcatttcctcgcatgcagcttaaatacctgaatttaagtaataacagaataaccaccttggaggctggttgcttcgataatttatcaagttccttattagtggtaaagttaaaccgtaaccgaatgagcatgattccacctaagatcttcaagctgcctcacctccaattcttggaacttaaaagaaacagaattaaaattgtggaaggtcttacattccaagggcttgactccttaagatctttgaaaatgcagcggaatggaattagcaaacttaaggatggagcattttttggcttgaataacatggaagaactagaactggaacacaacaaccttacacgagtaaacaaggggtggttgtatggcttgcgaatgttacagcagctctatgtgagccagaatgctattgaaagaatcagccctgatgcatgggagttctgccaaagactatccgaacttgatttgtcctataaccagctgacccgcctggatgaatctgcctttgtgggtctgagcttattggagagattgaatttaggagacaacagagtcactcatattgctgatggtgtatttagatttctttccaatcttcagacattagacttaagaaacaatgaaatttcatgggccatagaagatgctagtgaagcctttgctggactcacaagtctcactaaactaatcttacaaggaaaccagattaagtcaattacaaagaaagcattcattggtcttgaatcccttgagcatctagatttgaacaataatgctataatgtctatccaagaaaatgctttttctcagactcatttaaaagaactgattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtgatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatgagatgccatcttttctgaaaacgccaatggatctgactattcgcactggtgccatggccagattagaatgtgctgcagagggacaccctgcacctcagatttcctggcagaaagatggtggtactgactttcctgcggctcgagaaagacgcatgcacgtcatgcccgaggatgacgtcttctttattgccaatgtgaaaatagaagatatgggaatctatagctgcatggcacaaaatacagcaggaggtctctcagcaaatgcttccctaacagtgttagagacaccctcatttattagacccctggaggataagacagtaacccgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacagaggagctcaatctgcctgcagacattcccagctacttgtcttcccaaggaacgctgtctgagccacaggaaggctacagcaactctgaggcaggcagtcatcagcaacttatgcctcctgccaatggatatatacacaaaggcactgacggtggcactggtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtgaaacattgcagcggcccgtgtggaacataaacagagaactaggcctgcctcatcctcctttttcccagcagccagtccatgagtcaccacaacttcatcaaaatgagggcctggcagggagagagccagactgttctgcttcttccatgtcctgccacaggttacaggatcatgcttttgattttagtaggactcggaacattcaagatggtagtgagggcacatgaaactcacttcaggatgaaatctgggcagagacttattaattaattttgcatttactacctcagagctcagaagaaactccgaagtcagcatttgctttactctttctttatgattgcatctgaccgcaccaaggtgggccatgcgttgtttggtcttatacctgatgaagaaatggcaacagctgacagaaatgggtacagctcatcaaaaatgtgcagcaccggcagagggaagatacggggcaaatgtgcttcctgatgcttccatggggatgtgccctggtgtgcatctgcttgtcaggaagagtcacattgctgcttaacatgctggattgccctagtcttcagaatggtcctgagaaaacatcactacttcgatgttctactttgctttccaaggagcaaaaataactttggagccttctgggaagtgtgcctgggattcttcagtggtttcaggcagatagttgagactggggctttgatattcaaggtctttggcaagaatcccaggcttgaccaactggtaccaggtcaaagatttttgtattcttgtgaatttttttttttgtccctattgcccagggatgtcattgtaaatatatgtgcatttataaataatttttgtattcattgaccatatgtgttggctgcaatgtaaatatttttgatatgccaaaattatatgtaatatccagttataatattgacaagtagcttctcagatcacagattttaaataactcaatttagtgagatctaaaaattttatttaaagtataaaaactgtggctcacacctgtaatcccagcattttgagaggctaaggtgggaggattgcttgaggccaggaatttgagaccaggctgggcaacatggtgagaccctgtgtctgcaaaaaaataaattaaaaaaataggtggacattgtggcatgctgctgtagtcctagctacttgggaggctgaggtgggagggtcacttgagcccgggaaatcaaggctgcagtgagctgtgtgaagccactgcatcccagcctgggtgacagagtgaggccctggctcaaaagtaaaataaataaataaaaagttttaaaaacttacttgttaa

SEQ ID NO: 333606 - DNA, 2701 bp, Homo sapiens
gtccgtcaggccgtgtgtcccaggccgtcgaccccgctgtcgcgctgcgtctgctccttgcatgcctttagatggtacagccttcagccggggcttcgggagacagtgcagccaccgagcatctctgctgagcttctccgccgatcctccttttctagcaggcagctcttctaggccacgtccaggtcgagggggaaaatggcgccggcgcccctaggcgtcccggaggagcagttgctggggtgtcgatctagagtgctttctcggttactcttcattgcccagaccgctctcctcctgttgcccgccgccggagcaggtctctgccccgcgccctgctcctgccgcattcctctcctggactgcagtcgcaggaaattgcccgcaccgagctggagggcgctgtcgggcttgctgccccccgacaccgctatcctggatttcagtcataatcggttgtctaactggaacatcagcttggaatcacaaacattacaggaagtgaaaatgaattacaatgaactaacagaaatcccgtattttggagaacctacatctaatattactctactttcattagtccataatataatcccagaaataaatgcacaggcactccagttttaccctgctctggagagtttagacctcagctcaaatataatatcagaaatcaagacatcttcatttcctcgcatgcagcttaaatacctgaatttaagtaataacagaataaccaccttggaggctggttgcttcgataatttatcaagttccttattagtggtaaagttaaaccgtaaccgaatgagcatgattccacctaagatcttcaagctgcctcacctccaattcttggaacttaaaagaaacagaattaaaattgtggaaggtcttacattccaagggcttgactccttaagatctttgaaaatgcagcggaatggaattagcaaacttaaggatggagcattttttggcttgaataacatggaagaactagaactggaacacaacaaccttacacgagtaaacaaggggtggttgtatggcttgcgaatgttacagcagctctatgtgagccagaatgctattgaaagaatcagccctgatgcatgggagttctgccaaagactatccgaacttgatttgtcctataaccagctgacccgcctggatgaatctgcctttgtgggtctgagcttattggagagattgaatttaggagacaacagagtcactcatattgctgatggtgtatttagatttctttccaatcttcagacattagacttaagaaacaatgaaatttcatgggccatagaagatgctagtgaagcctttgctggactcacaagtctcactaaactaatcttacaaggaaaccagattaagtcaattacaaagaaagcattcattggtcttgaatcccttgagcatctagatttgaacaataatgctataatgtctatccaagaaaatgctttttctcagactcatttaaaagaactttacggtgctgtgactccgataggatcagattcatcattggacccccagacctctcacccaggaccccaagtgtgcacctttgaagccattgtcttcactcctgactgatagatcggggatccaatggtgagtcagactaacgaaccattgctccggacaaacatctgttgaagctggtaaggaaagatttcgattctcaagattgtgaatatattctctggagttgggctagaggccagacttcttttgaaaggtacctcctgggcttgaaggtcttcttcctggctctctttcctgagtggggtttattccctgactccctggactaaaagtccttggaactctgtgaggctactctgttgtctctaatggatcctacttctcccatggcaatttctctggcatctgaatcccctctgtttgagcccctgctaactatattgctccaccactggttctgtccacctcctccttgttggacctttattggcctgtttggaatacttaagatctccccagactgcatcctgtaagctgtctttcttcccattgctactgctccttattcctcctcttaccacctttaatgttccttccagttcccttgagccctttgatatgactcccttcaaattcttacatcctccatccatctgtccacccactgctagactttttccttctcattctggactctttgtcactgggactgtaggccccccacccttcctggggatctctcaggggacttggggactcccaaaagtaatgacttgggttgaaaaggaaaaagaacaattggaaatagcctaagtattttatctacactcagatgggctttggagatatccagacagcccctagatgtctcttcagcctccatgagattacacatcatggcaaaataaaagtctttttttttttttgagatggagtctccctctgtcacataggctggagtgcagtggcacgatctcagctcactgcagcctctgccttccgggttcaagcagttctgcctcagcctcctgaatagctgggattacaggcacccaccaccacacccagctaatttttgtatctttagaaaagaggagtgacctcatccaatttatgttttcttaggtataatataagctggactcaaaagacctgggcccatatcctaactctaccatttattttagac

SEQ ID NO: 333607 - DNA, 1735 bp, Homo sapiens
gtccgtcaggccgtgtgtcccaggccgtcgaccccgctgtcgcgctgcgtctgctccttgcatgcctttagatggtacagccttcagccggggcttcgggagacagtgcagccaccgagcatctctgctgagcttctccgccgatcctccttttctagcaggcagctcttctaggccacgtccaggtcgagggggaaaatggcgccggcgcccctaggcgtcccggaggagcagttgctggggtgtcgatctagagtgctttctcggttactcttcattgcccagaccgctctcctcctgttgcccgccgccggagcaggtctctgccccgcgccctgctcctgccgcattcctctcctggactgcagtcgcaggaaattgcccgcaccgagctggagggcgctgtcgggcttgctgccccccgacaccgctatcctggatttcagtcataatcggttgtctaactggaacatcagcttggaatcacaaacattacaggaagtgaaaatgaattacaatgaactaacagaaatcccgtattttggagaacctacatctaatattactctactttcattagtccataatataatcccagaaataaatgcacaggcactccagttttaccctgctctggagagtttagacctcagctcaaatataatatcagaaatcaagacatcttcatttcctcgcatgcagcttaaatacctgaatttaagtaataacagaataaccaccttggaggctggttgcttcgataatttatcaagttccttattagtggtaaagttaaaccgtaaccgaatgagcatgattccacctaagatcttcaagctgcctcacctccaattcttggaacttaaaagaaacagaattaaaattgtggaaggtcttacattccaagggcttgactccttaagatctttgaaaatgcagcggaatggaattagcaaacttaaggatggagcattttttggcttgaataacatggaagaactagaactggaacacaacaaccttacacgagtaaacaaggggtggttgtatggcttgcgaatgttacagcagctctatgtgagccagaatgctattgaaagaatcagccctgatgcatgggagttctgccaaagactatccgaacttgatttgtcctataaccagctgacccgcctggatgaatctgcctttgtgggtctgagcttattggagagattgaatttaggagacaacagagtcactcatattgctgatggtgtatttagatttctttccaatcttcagacattagacttaagaaacaatgaaatttcatgggccatagaagatgctagtgaagcctttgctggactcacaagtctcactaaactaatcttacaaggaaaccagattaagtcaattacaaagaaagcattcattggtcttgaatcccttgagcatctagatttgaacaataatgctataatgtctatccaagaaaatgctttttctcagactcatttaaaagaactgtaagtaacttgtctttttaaaatcaccagttggatcattgttcctgcttgttgtgcttaaagtgtgatgggagtgacccaagttatttccaaaagcacacagttcaggcaggaaaaaagaaagtattaatactcagttatttaagcggctagaggtaattttaaaatagccaacattgaaaagcccagagtgtgtggcaccaagaccttctgttttgcctgtt

SEQ ID NO: 333608 - DNA, 596 bp, Homo sapiens
tttgggaggctgaagcaggcggatcacctgaggttgggagttcaaactagcctggccaacatggtgaaactcctgtctctactaaatatacaaaattagctgggcatggtggcacatgcctgtaatcccagctacttgggaggctgacgcagtagaattgtgtgaacccgggaggcggaggttgcggtgagccgagatgacgccattgcactccagcccgggcaacaagagcgaaactccatctcaaaaaaataaataaataaaataaaaaattttgtagcaacagaatcgctaaaataacaggtgacagtagacgatatatagtatgatctcagtaaataattggttaggtttgtgaagtagagggatttgaaagaccatgttctggtggtggtttttgtgtgtgtgtgtgtgtgtgtgtgtgtgtgtgtgatttcagtgtccctattcaggaatattgaacatctttatttctttgaggatttggctaaaaggatattaagttttaccagtcactactgataattcttgtctttcattctcagaaacattgcagcggcccgtgtggaacataaacagagaactaggcctgcctc

SEQ ID NO: 333609 - DNA, 4505 bp, Homo sapiens
gtccgtcaggccgtgtgtcccaggccgtcgaccccgctgtcgcgctgcgtctgctccttgcatgcctttagatggtacagccttcagccggggcttcgggagacagtgcagccaccgagcatctctgctgagcttctccgccgatcctccttttctagcaggcagctcttctaggccacgtccaggtcgagggggaaaatggcgccggcgcccctaggcgtcccggaggagcagttgctggggtgtcgatctagagtgctttctcggttactcttcattgcccagaccgctctcctcctgttgcccgccgccggagcaggtctctgccccgcgccctgctcctgccgcattcctctcctggactgcagtcgcaggaaattgcccgcaccgagctggagggcgctgtcgggcttgctgccccccgacaccgctatcctggatttcagtcataatcggttgtctaactggaacatcagcttggaatcacaaacattacaggaagtgaaaatgaattacaatgaactaacagaaatcccgtattttggagaacctacatctaatattactctactttcattagtccataatataatcccagaaataaatgcacaggcactccagttttaccctgctctggagagtttagacctcagctcaaatataatatcagaaatcaagacatcttcatttcctcgcatgcagcttaaatacctgaatttaagtaataacagaataaccaccttggaggctggttgcttcgataatttatcaagttccttattagtggtaaagttaaaccgtaaccgaatgagcatgattccacctaagatcttcaagctgcctcacctccaattcttggaacttaaaagaaacagaattaaaattgtggaaggtcttacattccaagggcttgactccttaagatctttgaaaatgcagcggaatggaattagcaaacttaaggatggagcattttttggcttgaataacatggaagaactagaactggaacacaacaaccttacacgagtaaacaaggggtggttgtatggcttgcgaatgttacagcagctctatgtgagccagaatgctattgaaagaatcagccctgatgcatgggagttctgccaaagactatccgaacttgatttgtcctataaccagctgacccgcctggatgaatctgcctttgtgggtctgagcttattggagagattgaatttaggagacaacagagtcactcatattgctgatggtgtatttagatttctttccaatcttcagacattagacttaagaaacaatgaaatttcatgggccatagaagatgctagtgaagcctttgctggactcacaagtctcactaaactaatcttacaaggaaaccagattaagtcaattacaaagaaagcattcattggtcttgaatcccttgagcatctagatttgaacaataatgctataatgtctatccaagaaaatgctttttctcagactcatttaaaagaactgattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtgatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatgagatgccatcttttctgaaaacgccaatggatctgactattcgcactggtgccatggccagattagaatgtgctgcagagggacaccctgcacctcagatttcctggcagaaagatggtggtactgactttcctgcggctcgagaaagacgcatgcacgtcatgcccgaggatgacgtcttctttattgccaatgtgaaaatagaagatatgggaatctatagctgcatggcacaaaatacagcaggaggtctctcagcaaatgcttccctaacagtgttagagacaccctcatttattagacccctggaggataagacagtaacccgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacagaggagctcaatctgcctgcagacattcccagctacttgtcttcccaaggaacgctgtctgagccacaggaaggctacagcaactctgaggcaggcagtcatcagcaacttatgcctcctgccaatggatatatacacaaaggcactgacggtggcactggtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtgaaacattgcagcggcccgtgtggaacataaacagagaactaggcctgcctcatcctcctttttcccagcagccagtccatgagtcaccacaacttcatcaaaatgagggcctggcagggagagagccagactgttctgcttcttccatgtcctgccacaggttacaggatcatgcttttgattttagtaggactcggaacattcaagatggtagtgagggcacatgaaactcacttcaggatgaaatctgggcagagacttattaattaattttgcatttactacctcagagctcagaagaaactccgaagtcagcatttgctttactctttctttatgattgcatctgaccgcaccaaggtgggccatgcgttgtttggtcttatacctgatgaagaaatggcaacagctgacagaaatgggtacagctcatcaaaaatgtgcagcaccggcagagggaagatacggggcaaatgtgcttcctgatgcttccatggggatgtgccctggtgtgcatctgcttgtcaggaagagtcacattgctgcttaacatgctggattgccctagtcttcagaatggtcctgagaaaacatcactacttcgatgttctactttgctttccaaggagcaaaaataactttggagccttctgggaagtgtgcctgggattcttcagtggtttcaggcagatagttgagactggggctttgatattcaaggtctttggcaagaatcccaggcttgaccaactggtaccaggtcaaagatttttgtattcttgtgaatttttttttttgtccctattgcccagggatgtcattgtaaatatatgtgcatttataaataatttttgtattcattgaccatatgtgttggctgcaatgtaaatatttttgatatgccaaaattatatgtaatatccagttataatattgacaagtagcttctcagatcacagattttaaataactcaatttagtgagatctaaaaattttatttaaagtataaaaactgtggctcacacctgtaatcccagcattttgagaggctaaggtgggaggattgcttgaggccaggaatttgagaccaggctgggcaacatggtgagaccctgtgtctgcaaaaaaataaattaaaaaaataggtggacattgtggcatgctgctgtagtcctagctacttgggaggctgaggtgggagggtcacttgagcccgggaaatcaaggctgcagtgagctgtgtgaagccactgcatcccagcctgggtgacagagtgaggccctggctcaaaagtaaaataaataaataaaaagttttaaaaacttacttgttaa

SEQ ID NO: 333610 - DNA, 3713 bp, Homo sapiens
tgccagtgataacctgagagctggcaagaaagttttaactgttacaagaactcagtttaacataaaatttaaacagtaggtcaaagcaaatattgcagtctcaatcttcagagagtcatttagtaatttgagagttgtcacaaagattctttgcttgaccaacccgtaggcaagcccttaaaccttctcctaggcctagctgtgtaaaatccaattttagcacaaaccctgtaaaaccagtttagcaagaactcttcctcattgtagaccattcccaggtgatgtctgatcaccctggcctgtcttcagcaagaatcctgttagggtttagccagagtcttccttactctggatgttattttttagtaatttcacatccactgagtgggatgaaagcaaacccaccttgctccttggctatacttgcccttgctgtttccctactgtctctccctcactgagtcgaacccagtctctctccccagctgcaacatcacattgccgtggtccctatatctattgagatgatcctgaataacgtctaccttaccatgctttaacaagtatcactgagtaattttttatttaacagttacggtgctgtgactccgataggatcagattcatcattggacccccagacctctcacccaggaccccaagtgtgcacctttgaagccattgtcttcactcctgactgatagatcggggatccaatggattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtgatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatgagatgccatcttttctgaaaacgccaatggatctgactattcgcactggtgccatggccagattagaatgtgctgcagagggacaccctgcacctcagatttcctggcagaaagatggtggtactgactttcctgcggctcgagaaagacgcatgcacgtcatgcccgaggatgacgtcttctttattgccaatgtgaaaatagaagatatgggaatctatagctgcatggcacaaaatacagcaggaggtctctcagcaaatgcttccctaacagtgttagagacaccctcatttattagacccctggaggataagacagtaacccgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacagaggagctcaatctgcctgcagacattcccagctacttgtcttcccaaggaacgctgtctgagccacaggaaggctacagcaactctgaggcaggcagtcatcagcaacttatgcctcctgccaatggatatatacacaaaggcactgacggtggcactggtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtgaaacattgcagcggcccgtgtggaacataaacagagaactaggcctgcctcatcctcctttttcccagcagccagtccatgagtcaccacaacttcatcaaaatgagggcctggcagggagagagccagactgttctgcttcttccatgtcctgccacaggttacaggatcatgcttttgattttagtaggactcggaacattcaagatggtagtgagggcacatgaaactcacttcaggatgaaatctgggcagagacttattaattaattttgcatttactacctcagagctcagaagaaactccgaagtcagcatttgctttactctttctttatgattgcatctgaccgcaccaaggtgggccatgcgttgtttggtcttatacctgatgaagaaatggcaacagctgacagaaatgggtacagctcatcaaaaatgtgcagcaccggcagagggaagatacggggcaaatgtgcttcctgatgcttccatggggatgtgccctggtgtgcatctgcttgtcaggaagagtcacattgctgcttaacatgctggattgccctagtcttcagaatggtcctgagaaaacatcactacttcgatgttctactttgctttccaaggagcaaaaataactttggagccttctgggaagtgtgcctgggattcttcagtggtttcaggcagatagttgagactggggctttgatattcaaggtctttggcaagaatcccaggcttgaccaactggtaccaggtcaaagatttttgtattcttgtgaatttttttttttgtccctattgcccagggatgtcattgtaaatatatgtgcatttataaataatttttgtattcattgaccatatgtgttggctgcaatgtaaatatttttgatatgccaaaattatatgtaatatccagttataatattgacaagtagcttctcagatcacagattttaaataactcaatttagtgagatctaaaaattttatttaaagtataaaaactgtggctcacacctgtaatcccagcattttgagaggctaaggtgggaggattgcttgaggccaggaatttgagaccaggctgggcaacatggtgagaccctgtgtctgcaaaaaaataaattaaaaaaataggtggacattgtggcatgctgctgtagtcctagctacttgggaggctgaggtgggagggtcacttgagcccgggaaatcaaggctgcagtgagctgtgtgaagccactgcatcccagcctgggtgacagagtgaggccctggctcaaaagtaaaataaataaataaaaagttttaaaaacttacttgttaa

SEQ ID NO: 333611 - DNA, 2011 bp, Homo sapiens
gtccgtcaggccgtgtgtcccaggccgtcgaccccgctgtcgcgctgcgtctgctccttgcatgcctttagatggtacagccttcagccggggcttcgggagacagtgcagccaccgagcatctctgctgagcttctccgccgatcctccttttctagcaggcagctcttctaggccacgtccaggtcgagggggaaaatggcgccggcgcccctaggcgtcccggaggagcagttgctggggtgtcgatctagagtgctttctcggttactcttcattgcccagaccgctctcctcctgttgcccgccgccggagcaggtctctgccccgcgccctgctcctgccgcattcctctcctggactgcagtcgcaggaaattgcccgcaccgagctggagggcgctgtcgggcttgctgccccccgacaccgctatcctggatttcagtcataatcggttgtctaactggaacatcagcttggaatcacaaacattacaggaagtgaaaatgaattacaatgaactaacagaaatcccgtattttggagaacctacatctaatattactctactttcattagtccataatataatcccagaaataaatgcacaggcactccagttttaccctgctctggagagtttagacctcagctcaaatataatatcagaaatcaagacatcttcatttcctcgcatgcagcttaaatacctgaatttaagtaataacagaataaccaccttggaggctggttgcttcgataatttatcaagttccttattagtggtaaagttaaaccgtaaccgaatgagcatgattccacctaagatcttcaagctgcctcacctccaattcttggaacttaaaagaaacagaattaaaattgtggaaggtcttacattccaagggcttgactccttaagatctttgaaaatgcagcggaatggaattagcaaacttaaggatggagcattttttggcttgaataacatggaagaactagaactggaacacaacaaccttacacgagtaaacaaggggtggttgtatggcttgcgaatgttacagcagctctatgtgagccagaatgctattgaaagaatcagccctgatgcatgggagttctgccaaagactatccgaacttgatttgtcctataaccagctgacccgcctggatgaatctgcctttgtgggtctgagcttattggagagattgaatttaggagacaacagagtcactcatattgctgatggtgtatttagatttctttccaatcttcagacattagacttaagaaacaatgaaatttcatgggccatagaagatgctagtgaagcctttgctggactcacaagtctcactaaactaatcttacaaggaaaccagattaagtcaattacaaagaaagcattcattggtcttgaatcccttgagcatctagatttgaacaataatgctataatgtctatccaagaaaatgctttttctcagactcatttaaaagaactttacggtgctgtgactccgataggatcagattcatcattggacccccagacctctcacccaggaccccaagtgtgcacctttgaagccattgtcttcactcctgactgatagatcggggatccaatggattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtggtttgtatttttgttttaaaattttatatattacacacttataatcttaacagaattaaaaaaattaaaccagaatggttttccactaggaatttttgtaatcatacagttttaattgccattaaaaatgatcacaggcattttaatgaatgaaggcttttctcttttagagggactgttaaccttaggttaggtatttggtagtcaga

SEQ ID NO: 333612 - DNA, 158 bp, Homo sapiens
atatattaccaaatataagtggtaatgtgtgtgtatattatatatatgcatatcatataagctgtgaatatgtctagcataaaaattaaattcaggcagtgtaatacctataataggaattaactagctacttgtaactagccactttcctcattttt

SEQ ID NO: 333613 - DNA, 440 bp, Homo sapiens
atcccagtctactacagcttgcaagtagcagtgctcactgccactcttcagaaggaactcatgctgacaggagcatcagcgtcacacacaacctccaaggggggcatggcagggactagagggctcacacttgctcttagctatctctgaccaaaagtgacacacatcactaccaggagacaattcacccccaggtctcttgcatttttccacttcttgtgagcaagacactgattgttctttgctctgaactaccttttcaaagatgcttgtacagtaaatggccttggtagagtgtctccctccagatcaaagggcaggtgcgattactgcacagtataaaaagactcaggttctctaaactcagagctcctctcctataatgcaacccattatgtgtgcaggtatcatgtctctttgcattgccctagaggaatctg

SEQ ID NO: 333614 - DNA, 95 bp, Homo sapiens
gcgcaaatactctcaacaaaatatcgacaaattcaatccagcagtgcacaaaaagaattacagaccctacccacgcaggatttgtctcagacatc

SEQ ID NO: 333615 - DNA, 2355 bp, Homo sapiens
tgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagctggactgccccagtctttgactggttaccctcctctctgcaggtaggtttttctggatgataggacagatgatggattctccaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccaggtgccccccacagcatggctgagggaccccttcccagtagggctgtcccaagccccactccatggggccaggtttcctggcacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcaaaattggag

SEQ ID NO: 333616 - DNA, 2014 bp, Homo sapiens
tgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagctggactgccccagtctttgactggttaccctcctctctgcaggtaggtttttctggatgataggacagatgatggattctccaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccaggtgccccccacagcatggctgagggaccccttcccagtagggctgtcccaagccccactccatggggccaggtttcctggcacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactctaggtttagtttgctcttctttttccacgggtcttaaggtgtaaagtgaggttagtgcttcggtctttcttttcttttttttttttttttttgagatggagtctcgctctgctgcccaggctggagtgcagtggtgcactcttggctccctgcaagctctccctcccaggttcacgcc

SEQ ID NO: 333617 - DNA, 450 bp, Homo sapiens
  misc_feature (345)..(345): n is a, c, g, or t
  misc_feature (380)..(380): n is a, c, g, or t
  misc_feature (397)..(397): n is a, c, g, or t
  misc_feature (407)..(407): n is a, c, g, or t
  misc_feature (434)..(434): n is a, c, g, or t
  misc_feature (439)..(439): n is a, c, g, or t
gccgagaaggtgccactgcactccagcctgggcgacagagtgagacttggtctcaataaataaataaataaataaatgtaacatacacttaccacatgacccagcaatcccatttttaggtgtttaaccaggagaaatgaaaatttgtattcaaacaaaagtcggttcacaaatatttatggtcagtttatttataattgccccaaagtacaaacaagtcaaatgcacttcaactacagaatggataaattggtacatccatacagtagactactattcagcagttaaaaaaaaagccgttgagatactcaacaacatgaatgaatctcaaagggcctttatgcntaggtggggagggagggacaggacttccaaatggntttgttgcttccctggntttaccgggnggtgttgagggttgggggggttaggtntttgncttccattggg

SEQ ID NO: 333618 - DNA, 1359 bp, Homo sapiens
gccgagaaggtgccactgcactccagcctgggcgacagagtgagacttggtctcaataaataaataaataaataaatgtaacatacacttaccacatgacccagcaatcccatttttaggtgtttaaccaggagaaatgaaaatttgtattcaaacaaaagtcggttcacaaatatttatggtcagtttatttataattgccccaaagtacaaacaagtcaaatgcacttcaactacagaatggataaattggtacatccatacagtagactactattcagcagttaaaaaaaaagccgttgagatactcaacaacatgaatgaatctcaaaggcattatgctaagtggaagaagacagactcaaaatgctatgtgctccatgattacaggagatgtgaggtgggggtaagacttgactacaatagggcagtgtgcaattttggggaatgatggaacccttttatatcttgattgtgatgatgtctacctaaaggtatgcattctgccagactcacaaaactgtacacaaagactagtcaatttcactgtatgcaaattgtagctcaataaaccagactggaaaagttgaaccataaacattttatataactggtatcatattgtatgtatccttctgcaacctgctttttttgctcactactaatgacttttgaggtttatccaagttgatactacgtagactataatgatatatgtagcttttctttctttattttaactgctacaacatattccattatacattatactttgtttatccagtctcctgttggtgaacatttactttgtttctgtttttttctcttgttttaaacaatgttgcaataaacattcctgtaaatgtattctatagcactagtgctggaatctctctgcaagatatttacgtagaatagtatgtggaatggttgggataagagggtggtgaatatctctgttttgctctccaagggcttataccaactgacactctaccagcatgtgtcagaatctcctttttctacacacccatcaataattgggattatcagactttagcttttgcttagctgataaatgtaaaatgatatattgttgctgctttatttttacaatttctctgattgtcattgtggttgaacatctattcatgtttgtgggtcatttgggttttccttctgtgaattgcctgttcatattctttgcctgtttttttttttttttttaattgtcttcccttccattcccttccccttccccttcctctcccccttcccctccttttcaaataaattgtgcatcaggatgtagagagagtggaagagggagttcagaggcaccaggtgaccaaacgtaag

SEQ ID NO: 333619 - DNA, 93 bp, Homo sapiens
agacagatttataaatgacaggcaacagtcttagtttctttccctacccttttctattcctgttgaggcattgacttttacttgttttgtttt

SEQ ID NO: 333620 - DNA, 411 bp, Homo sapiens
tctatggttatcttgttccacgagaactacaagtcttctggtctacttaggatgatagtcatatttgtatgttacgttaaaaaattggtcacatttgtaagtgattttagagagacaacattattaaatgaattatttcaaaaagatacttaagttggtgaaggttcatctctaaaattcaaacatgctactttaattggcctcataagatatttatttaaaatatatttattgagtactcactaaatgacagtgttcttttttacttttcttttccatcatcatttctcatcaattgcataaaaacaaattttcaagtaagaaagagtaaggaaaaaaatatgattaaaattaggatttctttttattttattttaagttctgggatacatgtgcaggacatgcaagttt

SEQ ID NO: 333621 - DNA, 306 bp, Homo sapiens
ccacaacaactgatccagaggtgagcatgtgacctaaggtgatcaaaacttaggatctcagatcttttactggaatgttagagaaaagactctcctactggccatatgttagggaatatacagctttggaaactactgctaagcatctagggatcataaagacagcaagccttaaaataatggcaacagaacagaagccagagtaagtggaggaaaagcaatcaaatttttgatgacactgttgagccactggatcaattcttatctgaagccaactctacttgctactgaaagcattctaagaga

SEQ ID NO: 333622 - DNA, 630 bp, Homo sapiens
gttactagaagggctccaggatggaggccggcctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaaggacaaactattcgagagaaaagaattgtagaagcagcaaataaaaaagaagtagactatgaagcaggggatattccaacagaatgggaagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333623 - DNA, 702 bp, Homo sapiens
attatggccaaagtctaaatttgaatactgtgctgactgacccttttctactctattgttgcgcaaatgatactcttcaaggaaggattatggcagcctgagaaatcaggaaagcatggcttggaactggccaaaacaaaatccagcaagatctctttgaaggacaaactattcgagagaaaagaattgtagaagcagcaaataaaaaagaagtagactatgaagcaggggatattccaacagaatgggaagtttcttacagattctggatattatactttgatgtcttacatttaagtctttaaaccatcttgagttcatttttgtatacggcgaaagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333624 - DNA, 389 bp, Homo sapiens
  misc_feature (64)..(64): n is a, c, g, or t
ggggcacagcgcgaacatatttataacacataccatcacagttgtcgccttctggcaataactnagcgaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333625 - DNA, 395 bp, Homo sapiens
  misc_feature (56)..(56): n is a, c, g, or t
  misc_feature (58)..(58): n is a, c, g, or t
  misc_feature (61)..(61): n is a, c, g, or t
  misc_feature (71)..(71): n is a, c, g, or t
atttaatgtaatataacttatttatgtttataccaaccaagttgaattaatggctngngcnctccctcggngcgaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333626 - DNA, 385 bp, Homo sapiens
tcctctaccaccgacatagtgccggaaagttaaagaagtccccacccctttggtaataccaacgaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333627 - DNA, 380 bp, Homo sapiens
ttggttttcggccgccccccgggccggttcgaaaaaagagagagggttttggggcggggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333628 - DNA, 379 bp, Homo sapiens
cacgcgaccggaaccaacgcgccacacgcgcaagacacacgcgcccggcgcgcctaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333629 - DNA, 382 bp, Homo sapiens
  misc_feature (12)..(12): n is a, c, g, or t
  misc_feature (51)..(51): n is a, c, g, or t
agaggtaaggcnacacaacgtgatatttttattaatgtatagttatgcggnggtttcttggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333630 - DNA, 374 bp, Homo sapiens
catctttcgtcaattatagtcgcagctacttccgtgatcgcgagttaataacgaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333631 - DNA, 375 bp, Homo sapiens
taacctctgctctttcaccaccacccgtgaagaagtccagcgcaccccttaaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333632 - DNA, 411 bp, Homo sapiens
gttactagaagggctccaggatggaggccggcctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaagagcacgtgggcacggaccaattcgggaacaaatactactacatcccgcagtacaagaactggagaggacaaactattcgagagaaaagaattgtagaagcagcaaataaaaaagaagtagactatgaagcaggggatattccaacagaatgggaagcttggattagaagaacaagaaagactccacctactatggaggaaatactaaagaatgaaaaacacag

SEQ ID NO: 333633 - DNA, 753 bp, Homo sapiens
gttactagaagggctccaggatggaggccggcctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaagagcacgtgggcacggaccaattcgggaacaaatactactacatcccgcagtacaagaactggagaggtgaggtggcggcgtgggcagcgattgcgtggtcagtgattgcgaggacaaactattcgagagaaaagaattgtagaagcagcaaataaaaaagaagtagactatgaagcaggggatattccaacagaatgggaagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333634 - DNA, 666 bp, Homo sapiens
gttactagaagggctccaggatggaggccggcctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaagagcacgtgggcacggaccaattcgggaacaaatactactacatcccgcagtacaagaactggagaggacaaactattcgagagaaaagaattgtagaagcagcaaataaaaaagaagtagactatgaagcaggggatattccaacagaatgggaaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333635 - DNA, 426 bp, Homo sapiens
agtattgatgtgtttttccccggtaaaggttgtgaggtcaattgagtcgccccgctgactccgccttcttgttggcttttattacaagttagactccacctactgaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333636 - DNA, 694 bp, Homo sapiens
gttactagaagggctccaggatggaggccggcctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaagagcacgtgggcacggaccaattcgggaacaaatactactacatcccgcagtacaagaactggagaggtgaggtggcggcgtgggcagcgattgcgtggtcagtgattgcgaggacaaactattcgagagaaaagaattgtagaagcagcaaataaaaaagaagtagactatgaagcaggggatattccaacagaatgggaagcttggattagaagaacaagaaagactccacctactatggagtgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333637 - DNA, 707 bp, Homo sapiens
gttactagaagggctccaggatggaggccggcctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaagagcacgtgggcacggaccaattcgggaacaaatactactacatcccgcagtacaagaactggagaggacaaactattcgagagaaaagaattgtagaagcagcaaataaaaaagaagtagactatgaagcaggggatattccaacagaatgggaagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333638 - DNA, 1169 bp, Homo sapiens
gttactagaagggctccaggatggaggccggcctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaagagcacgtgggcacggaccaattcgggaacaaatactactacatcccgcagtacaagaactggagaggacaaactattcgagagaaaagaattgtagaagcagcaaataaaaaaacaaaaaaaaaaaaaaaaaactttgtgggggccggcctcgggccccgaaaaagttttttaaaacccccttcgttgtttggggccccggggcccccagaggtgtacgggagaacatcgtgggccacaaaggtgtggtccccgggggaaaatcccggggcaatggcaccaaggtggttggggtttctcccccaattaaaaaacagcgcgccgggggggaacacccggagcgggtttggggaaacaaaactccaggagggagaggtccggagggggccagtagcggggtccaatacacaggggggagtccaagggagaggcgtccggtaatctagaaatttaggcggcccggacgtgtggaaacaacgagagaaccaagtcaagagctgaatacagaacagtactagcagcaggacaggagcaacgcagacaaacaacaggacacagaaccagcagacaaagtgaacagcgagagagacagagacgataccagccgagtcgatgcactactacgcacaagagtacaaagacagcgaacaaagcagacacccatggccccacgccacaaggcagaacgtagggccaagaagaggaaatgagggaacaactacaataaacacaaacaccgcacagaacaacaggaccatcacacagggacagagcagacaagacaacaatggagaaccagcaggcaaagaggaaaccaacgcagagacaccgacactcagaaacagtggagaggacaacaacaagaacaacgcctcaccagcaagaaagcacgaacagacgaggacgacgaacacacacgcgccacaccgactgcgccacacgcaagcgaaccgagaacaaacccgcgaacaaccaacaaatg

SEQ ID NO: 333639 - DNA, 617 bp, Homo sapiens
gttactagaagggctccaggatggaggccggcctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaagagcacgtgggcacggaccaattcgggaacaaatactactacatcccgcagtacaagaactggagagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333640 - DNA, 799 bp, Homo sapiens
gttactagaagggctccaggatggaggccggcctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaagagcacgtgggcacggaccaattcgggaacaaatactactacatcccgcagtacaagaactggagaggtgaggtggcggcgtgggcagcgattgcgtggtcagtgattgcgaggacaaactattcgagagaaaagaattgtagaagcagcaaataaaaaagaagtagactatgaagcaggggatattccaacagaatgggaagtttcttacagattctggatattatactttgatgtcttacatttaagtctttaaaccatcttgagttcatttttgtatacggcgaaaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtt

SEQ ID NO: 333641 - DNA, 733 bp, Homo sapiens
gttactagaagggctccaggatggaggccggcctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaagagcacgtgggcacggaccaattcgggaacaaatactactacatcccgcagtacaagaactggagaggtgaggtggcggcgtgggcagcgattgcgtggtcagtgattgcgaggacaaactattcgagagaaaagaattgtagaagcagcaaataaaaaagaagtagactatgaagcaggggatattccaacagaatgggaagcttggattagaagaacaagaaagactccacctactatggagcttggattagaagaacaagaaagactccacctactatggaggtaagactacacaaggaggatatcatttaggagtatatattcccaaggatatacgaagcttcagaaaaactatgatgtattttctcaaagtgttgattttattccatcacagaaaataacttaaaacattttataataaattaatatataaacctatattattaataaaataatatatgataaaataaatgctcatattatggaatataacaaaatttgtataaattttaaagtgaaataataaaaatttaaaacaaaatt

SEQ ID NO: 333642 - DNA, 387 bp, Homo sapiens
atacaaatgtatatatgtataatttgtttattgtttgataaaagtgaatcacattccataaacttcctatttactttcctcatttgatggtacaccatggatatatttccaggtcaatagatctagatccaattcactgaaaataaacctgccaaatataattgttttgctgctaattcaacctttattgatggacatcaggattttccagttaccatcaacaatatcacaataaacattcttgtatgtacatcctttatagaagtatgtatctattacttctgtagaatatgttcttggtttgttgggttaaaggtaagtgtagccgagcatggtggcttacgcctgtaatcccagcactttgggaggccaaggtgagtgaatcac

SEQ ID NO: 333643 - DNA, 120 bp, Homo sapiens
catgttagcaatggagaaacaaggattagattggaaatgatcggtttgcctctatttgaattatatttatagtgagtgtcttgctagtcagaagtcacagaaatcaattttgtctatcct

SEQ ID NO: 333644 - DNA, 385 bp, Homo sapiens
gccctttacctcacttaggagatctattctagtctgttctcagtccttccaaattctacttgaattttaaggccttgcataaattccactcccaccactaaaccttctcaagaccactctagcctatggatatcctgtctatggactatttaactagctctcaataccacttatttctcccttatcatatattatttagtattattacctgtttcaagtgtatcctgtctagaaatcctgacatatgagaatgacagaagaacttgagggtgcttggcctggaggggagatgtttcaaggacacattaggtaaatatatttttaaacgattgaagctttgtcatatagaagaagaattaagaattaacctttgttgctccagaag

SEQ ID NO: 333645 - DNA, 480 bp, Homo sapiens
taatagtggataaaattcagaaacattaatgccccagttctgcttaataactagctttgcacaggcaaatagtcacagattatgtctatacttgaaatccaaggaggaaatcaaaacacatgcaccacctaatctacttctctgtctactttcctcaacctacccaatagctgcattttggcactttggccaacctccaagagtggtttacaaagcaaaatatcttgtggaggagttctcatattcataagatcaggtttctttgtatatctggtgagaagagagtgtaaccaggaaggcagatgaagccattttttaaatcaaaagaacatcttactgcctatgagtctttacctgtcttgctactgatgccaccacaagtgtcttgaagggaaggacaggaaagttttggggaaagtgatagagtaaggagctttcatgctctaggcttccccatgatcactaatggcaatgcaactc

SEQ ID NO: 333646 - DNA, 172 bp, Homo sapiens
tttcttattggtcagcgggctggctatctcagaactaggcgtgtgtgcacacacacatgttcatgcatgtgttctattttttattttgttattatttttttgaggttagttggattagtcatggtggggtggtgattagtcggttgttgatgagatattgggaggtggggat

SEQ ID NO: 333647 - DNA, 567 bp, Homo sapiens
ttcagaaaaggtggttttgcagatggatgggagtggtgcaggcactttgttttcacatggcttctttccccaagcagtaagccccttccaacattgccaaaacatcctgcagtttttaccagggttcctgcgctgagggcagagctgagtgcagatcaaaggagaaagagaaagaagttggaggttttgttgtaatgtaagacagtttcatcagcctatggatttaaaagtccaggctgacttacctcttcctttcctatagattgctcaggaaatatggttattctagtacgtgctaagcatcgttgtaaaaagtaagcccacagcctaaaatactttgaatgtcttagacaaatgtccaatgtttgctacggttttggattatcaaggccactccttacctctatgagtagccaagggtagtgctctaagctgtgagctagcttctctcagagatgcccacaaacataaacaccccttttcaaagtaagctgctatggactcataggactggaaaatacttcagagagtaatccctccattttattaaagagaatactgaaacct

SEQ ID NO: 333648 - DNA, 209 bp, Homo sapiens
ttaataaatatgtcagaggcattgtttaagttaaatataactttttcttttttaccaatttgttgattcagttgccattctgcaaagatgcttacaaattctaatacgataaataagtggatataattggaatactaactgaaagtaaaaagacagttgactgaagacacttattttactgaatttcaaaatcaagttatgaatttctg

SEQ ID NO: 333649 - DNA, 144 bp, Homo sapiens
aacccttgcaactctgggtgaggatcttattgaagataaccttgatcactgttctgtagcttgacgatgatcccaaggagtgtttacctaatagtgcaggatctgtatactttatttttagacagtaagtgaatttacttaata

SEQ ID NO: 333650 - DNA, 326 bp, Homo sapiens
cacttatacacacaagtctggagtctgaggaaagaagttcagactgggctaggtgcagcggctcatgcctgtaatcccagcactttgggaggccgaggtgggcacatcacttgaggtcaggagttcaagactagcctggccaacatggtgaaacccgtctgtactaaaaatacaaaaattagctgcaggtggtggtgtatgcctgtaatcccaagtactcaggaggctgaggcaggagaatcacttaaacccgggaagtggcggttgcagtgagccgcgatcacaccactgcattccaacctagatcagagtaaaactcttgtctc

SEQ ID NO: 333651 - DNA, 422 bp, Homo sapiens
  misc_feature (270)..(270): n is a, c, g, or t
ggcaccaattaatccgggactggagcatctgcagactttgctatccaaggggggtctgaaaccaacccctagatactgagggaccaacccccagatactgagggatggctgtcatgtcatgaggtgttcccacagtacccactgcgtggcatgcaactgacaacgttcttacttaatctggcacccagggccacccctactggagggatccttggtgccgatgaatagcgaggtgccgatgaatagcgatcgctattcatcggcaccacngctcagccccctggattcagcctttttcctaaggatatgtacagaggtcaaacctcccgctttgctggagttgcaactacttttgctgggaagtctggagagtccgagtatcaaagcttttctgggtctccacatgtgcctgagtggctgtt

SEQ ID NO: 333652 - DNA, 434 bp, Homo sapiens
ctgttgtctgtgatgagtaacccgaaatgacaagtaggaaagacaggtacgggggaatccttggaagtcagtgtaccttggaagtcaggtacaggtagagagggatgtgagcgacaggtgtgctcttaggtgacctgtgtgtggccagctcttctggaagggcaggtgttggggtggttaaggaggtgcaacactgtcacggaggaggatgggtgagggccaggaggctggggactggtgggggcaggccttacctgaggggacaggttagcaggttgcatgtgtgagtgcttgtgtgcaacagaaggaatgtgtgtgtgagtgtgtgcatgtgtggtgactcggtactgcttgagaggaggaagaggtgaagaaatacgaatgtgtgaggaacaggtgagtttgcagctttaggggacaggtgggatggctca

SEQ ID NO: 333653 - DNA, 402 bp, Homo sapiens
ccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaattta

SEQ ID NO: 333654 - DNA, 372 bp, Homo sapiens
tcaaagtgtcatcctgcccccacaggaaaagaagaagccagaactgctgcttcccgtttactacaggtatactggccagggcctcaagtgcacctttgataatccctgactcccctttagggactcccaggtggactcacactcccgatttcagaatgcactctcccatcaacttcatgttctccaccaccggcctgctctctgagagctctgcaaagtaaggtttctcaatttgcactgctgacattctgggttggataatttttgttgtgggagctgccctgttcattatgggatgcaagcagcatccctggctcatacccaccagagcacaaactcctagctgtgaaaaccaaagatgtctcagacact

SEQ ID NO: 333655 - DNA, 1244 bp, Homo sapiens
atgcgcagcgcgcgctctacggcgctgaaccggggcgagcagagagctgtcagatactatagccatatgaagttgaacatggcagaagaagaggactatatgtctgattccttcattaatgtccaggaaaagtggcattggtcatgaggcatcattaaaacggaaagcagaggaaaaattggaaagctacagaaaaaagattcacatgaaaaaccaagctgaagaaaaagctgcagaacagtttcgaatgcgacttaaaaataagcaagatgaaatgaagctagaaggagatctcagaagaagccagcgagcctgtcaacaactggatgtccagaaaaatattcaggttcccagggaagcatggtactggttgaggcttgaagaggagactgaagaagatgaagaagaaaaagaacaggatgaagatgaatataagagtgaagatttaagcgtactggaaaaattacaaatattgactagttatttaagagaagaacatctatattgtatttggtgtggaacagcctatgaagataaagaagacctatcttcaaattgtccaggaccaacttctgcagatcatgactaagattattcccaataaagtggaaacttgaaaaatgttattacttcctagggatagacaatttagcagttggaaatctcaaattttttatgccagtaaagaaagggggactttatataatgttttgttctttttgtactttagaatatgaatgttcattgacttgaaaaaaataatgcaatggcatttcagaacacaagtatcacagagatggacagttacaatttattgctatattgtgatacgtgaggggtttaaggacaccaacaggtaacttcttattcccctcttcactttggaacaaattgagaaataagaaatgggagtcagaggaagagaaaaatatccactttatcagtgaataaactgatacagagaagaaggttgactttttctccagtcagagactgtaatatttctccctgattggagagaacagcgggtctctgccttgttggggcagagcccatctttgcattctgagaccagttagctttcaaggtcagggaaaccaccaggggctggaccacacatgctcagttccttcttgtatcacccatgggataagacagttctctcttgggaaggaatgaatgagggttcagagagctttttcctacacttcttgctttgaaggagcaaggagaagttcccttcc

SEQ ID NO: 333656 - DNA, 182 bp, Homo sapiens
atgcgcagcgcgcgctctacggcgctgaaccggggcgagcagagagctgtcagatactatagccatatgaagttgaacatggcagaagaagaggactatatgtctgattccttcattaatgtccaagaagatatcagaccaggattgccaatgctaaggcaaatccgagaagcccgtcgaaa

SEQ ID NO: 333657 - DNA, 465 bp, Homo sapiens
gatgaatataagagtgaagatttaagcgtatgctttgcaccatttccttcatagggtgtctcagccttggcaacattagcactttgagttgtggtaatccgttgttgtggagagctgtcctgtgcattgcaagatgtttagcagcatctctggcccctgcccaccagataccagttgcacttttgcttatgacaaccaaaaccctctccagacattgctaaatgtccccgaggggaaaaataacccctggttgagaggtactgcattgcaggattactttactaaccccaaatcaaaacttacatataatttttccctttagcttccatttgtcctctcatctcagcttcagtttggatgatgaattagcaacaaatgtaaattattttaatttataccttatttcctgcaaaacttctacaagtcattctaatgtgtacttttttctcctacttataaacaaca

SEQ ID NO: 333658 - DNA, 498 bp, Homo sapiens
gcgcagcgcgcgctctacggcgctgaaccggggcgagcagagagctgtcaggtaagagagctgtcaggtaagggtctggggacaaccggtagaatgataaaaggcagagtgcgctggccatgactaccgtatcacaccgtcagccacttttccatccgtgggtggttgcgtctgtgggacgcttgcagccaggaggaacgcgtgagggaagggatcagcggttcctgagcgtagtattgagagtgggacgtttcttgtcacatttatactgtaggtccatttctccacttgtatatgtaatgggactctcaatatgtctgtttcccgactacgccccctaaaaaaacaaaaacaaacctactcctacagtcttcccactctcaaaaaacgttaactccgttcttccatgtattcaggccaaaaacttagcgttatcttgacatcgttctttacgtactacctacaacatcagcaaatcctgtaagctctaccttcaag

SEQ ID NO: 333659 - DNA, 1150 bp, Homo sapiens
gttgaaccaattcctctcaatatcaaaacagggaaaagtggcattggtcatgaggcatcattaaaacggaaagcagaggaaaaattggaaagctacagaaaaaagattcacatgaaaaaccaagctgaagaaaaagctgcagaacagtttcgaatgcgacttaaaaataagcaagatgaaatgaagctagaaggagatctcagaagaagccagcgagcctgtcaacaactggatgtccagaaaaatattcaggttcccagggaagcatggtactggttgaggcttgaagaggagactgaagaagatgaagaagaaaaagaacaggatgaagatgaatataagagtgaagatttaagcgtactggaaaaattacaaatattgactagttatttaagagaagaacatctatattgtatttggtgtggaacagcctatgaagataaagaagacctatcttcaaattgtccaggaccaacttctgcagatcatgactaagattattcccaataaagtggaaacttgaaaaatgttattacttcctagggatagacaatttagcagttggaaatctcaaattttttatgccagtaaagaaagggggactttatataatgttttgttctttttgtactttagaatatgaatgttcattgacttgaaaaaaataatgcaatggcatttcagaacacaagtatcacagagatggacagttacaatttattgctatattgtgatacgtgaggggtttaaggacaccaacaggtaacttcttattcccctcttcactttggaacaaattgagaaataagaaatgggagtcagaggaagagaaaaatatccactttatcagtgaataaactgatacagagaagaaggttgactttttctccagtcagagactgtaatatttctccctgattggagagaacagcgggtctctgccttgttggggcagagcccatctttgcattctgagaccagttagctttcaaggtcagggaaaccaccaggggctggaccacacatgctcagttccttcttgtatcacccatgggataagacagttctctcttgggaaggaatgaatgagggttcagagagctttttcctacacttcttgctttgaaggagcaaggagaagttcccttcc

SEQ ID NO: 333660 - DNA, 1086 bp, Homo sapiens
ctctcagtgacaaccaaagaatggataaattagagaaaaccaacagcagcttacgcaaacagaaccttgacctccttgaacagtttcgaatgcgacttaaaaataagcaagatgaaatgaagctagaaggagatctcagaagaagccagcgagcctgtcaacaactggatgtccagaaaaatattcaggttcccagggaagcatggtactggttgaggcttgaagaggagactgaagaagatgaagaagaaaaagaacaggatgaagatgaatataagagtgaagatttaagcgtactggaaaaattacaaatattgactagttatttaagagaagaacatctatattgtatttggtgtggaacagcctatgaagataaagaagacctatcttcaaattgtccaggaccaacttctgcagatcatgactaagattattcccaataaagtggaaacttgaaaaatgttattacttcctagggatagacaatttagcagttggaaatctcaaattttttatgccagtaaagaaagggggactttatataatgttttgttctttttgtactttagaatatgaatgttcattgacttgaaaaaaataatgcaatggcatttcagaacacaagtatcacagagatggacagttacaatttattgctatattgtgatacgtgaggggtttaaggacaccaacaggtaacttcttattcccctcttcactttggaacaaattgagaaataagaaatgggagtcagaggaagagaaaaatatccactttatcagtgaataaactgatacagagaagaaggttgactttttctccagtcagagactgtaatatttctccctgattggagagaacagcgggtctctgccttgttggggcagagcccatctttgcattctgagaccagttagctttcaaggtcagggaaaccaccaggggctggaccacacatgctcagttccttcttgtatcacccatgggataagacagttctctcttgggaaggaatgaatgagggttcagagagctttttcctacacttcttgctttgaaggagcaaggagaagttcccttcc

SEQ ID NO: 333661 - DNA, 473 bp, Homo sapiens
tctgccaggaaacatttccaaaaaggaaaggttttgtctcaattgctgtggcagcaaacacttccgttggagctgttagagcggtatcaggatactctcactggcttacatagctttcaaaatatttgtgttgctaccacgctcctttgccaatatatgtgacttgtaatacttttttattcatctggatgtatttatacaactgtgtaggtccagaaaactttttaaaagttggcgtaaatatgctgtgatgaaaactgagaaatacatctgcctttctcactatgtagaaatactacatttgcaaattagggtacaaatcagtcttcactttcaaagaccaaattaagcccttagagaggtcaaatttaaataacatcactatatattacagagaaaataccagcatcttatgtaagctttacttaatcctcaatattttattaggcagatccattctcagagctaaggag

SEQ ID NO: 333662 - DNA, 282 bp, Homo sapiens
gaattcctaaccacctatctacagactgttaaatgttgcctcttctgggagttcttcccaaataaccttttcctgccccacacagcaaaacgaatccccccttgcgttctagaccttccactggaacacctgctgtgcagtcctgggcttggctcacatgcactccctctacgcctctgagtcagggttatctgagcgcgtgctctgcactgtcactgtacctctgaggtctacgtgaactgccccctgtgggctgtggtgcaaaacctgtgtatgtggtgg

SEQ ID NO: 333663 - DNA, 582 bp, Homo sapiens
tatccaaagcgtatgggaatctcttttcttagcaactcgaaagtactgcactccaagttcttgcaggagagtaccaacctcgaacttcagccatcaacaacatctcatacaagaagtcccactgaagcaaactgatttttgagacagggtgaacacagtcattaatgccactcatatctcagggcattctaaccctgactcccacatcaaggtaatatgaagacactgagctacccattgatgctgctgcttctacatttactgagagccaatataaagaaggacagtaattatgaatacttctgcacttccaaaaccacaattggacctagaatgtattaagatgctctcccaagattcatttcagatttcagttccagagggaaaaggtttatctttcccgaagaactgggggacctctttttatcaaacaatgaaagttacactcatacatttcttgtcatctttgacagccaggaagtttaaaattgaactaacttggtcacaaattgctggcattaccactggctttgggatctagaacatttattttcaacattaatttttgatggcttacttgta

SEQ ID NO: 333664 - DNA, 541 bp, Homo sapiens
ctttttttgtcctcgggggtttatggatttattattttactgtcttctaggatggtttaggaaggagtggaaagaaacatgtatcttaacctgccatgtttaactggaaatctttatttacctttagtttcatttcttcttactcactatatgctttctacactccagctgtattaatctactctcaggtagccccatattttctgcttctttatccttgtatactgctgttctccttcaggaactaaaatatctcctctacctttatactctcaaagctaggtatgcatatttccatcatactataaaacagcaatttttcactgaggagcaagtaccatgttcaaaatatagagtgtttgggagagaccaggcccacaaatgtctggaaacatgtccaacttactaaacagaaaactgtgcttttatataaaaaggtcttaatcaaatatataataaagtatgaccgcctgacatctattttgctaatagtagaaacaacataattaggttaaaaggtacgtgtgctggctgggcgcgg

SEQ ID NO: 333665 - DNA, 315 bp, Homo sapiens
tgggggaaggggaaaccgtcagagacccagagacaggcaagagatgacagagaccagggcagaggggactggatccaagaaggcactcagagtagaaagaggcagatgagtcccagagttgggcatttctcgcctgggattctgactcagggggcccgtattgtcccaagagctcggactccagggcctgggagaaccaggctgaagcagctccccagcctggcccggccactcagagagacctctcctgggcctcgagcccccaccctcaccccagctcccacatctctggggcaggccctgcccggctacccc

SEQ ID NO: 333666 - DNA, 330 bp, Homo sapiens
gcttcagcagaaggtgggagcagggggtgtgcagatgacaccagctgccaggacaagccttgctgtaaggatgcaggatgcgaatgggagaggcaccaagggccgcagagaaggagccgtgctgcactgggctgccgtgaagacgaggtgggcggcctcggtggctgtgactgtagcggagctgtgagggtgaagacgaggtgggcggcctcggtggctgaggcggagctgtgagggtgaagacgaggtgggcggcctcggtggctgaggcggagctgtgagggtgaagacgaggtgggcggcctcggtgactgaggcggagctgtgagg

SEQ ID NO: 333667 - DNA, 197 bp, Homo sapiens
tcaaagtgtaagcccaaagggttttttaatgactaaaatatatttcagttatttctatgtttagataacagtattgaggggggccaggcacagtgggtcaaccctgtaatcccaacactttgggaggctgagacaagaggatcgcttaaggctaagagttcaaggttggaatgagctatgattgccctgctgaactc

SEQ ID NO: 333668 - DNA, 198 bp, Homo sapiens
gactaaagtgagtgtaaagaagacagtctggactctggggcagcacaagggtcacagggagccccagctctgaaggctgtcctggctgcaggctctctgagctgcccctggggagctgagggtccaggaagtttgctgcttaggcccagagaggagctggcctggcactggaaagaggagaaagacaggtggggccat

SEQ ID NO: 333669 - DNA, 390 bp, Homo sapiens
tgaagttagttaagcgaaccatttaaataaacgatcagccttagcattctggggaagtcattgggcctaaagaagataaattttagcattctaagtttctgtgtattttctttaatgctagctttgaaatgcaatcaaatttcagtggaaatagaggcataaactaaatttctaatcaattaaaaaatactttagtggtgggcatggatgggtagaaagatatttagccaaacaagccttactggggggaaaataggtagttagaattctagccaacacttcaaaaatgtggaagtatttacaaagtagtccttagttgggggatgctagagtacacttattaaaatttgcttttggtgctgtggctcatgcctgtaatcccaacacttt

SEQ ID NO: 333670 - DNA, 508 bp, Homo sapiens
aaaaaaaaaaaaattagctgggcatggtggtggactcctgtaatcccagcaactcgagaggctgaggtagaagaatcgcttgaacccaggaggcagaggttgcagtgagccgagatcatgacactgcactcccgtctggacaacagagcgagactctgtcaaaaacaaacaaacaaacaaaacccacagattaaagaacaagtaaaattaccactatttggaatgtaatgaaaatgaaaacatagcacatcaaaatgtgtagtgacactaaagcaaacttaggaattatttatagcactaaatgtctatatcagaaaagaaaaaaaaaaaaaagaggtaaaatcaatgaccttagcttccaccttcagaaactagaaaaagaagagtttttatgccaaagtatctaagaaaaaggaaataataaagataacagcagaaataaatgaaatataaaaggaatatatataatattccacatatatgatacctatatgataaaaaaaaatat

SEQ ID NO: 333671 - DNA, 542 bp, Homo sapiens
aaactcagtattttacttgtttctgatttttttccccttaaaatgttgccatgacatgttaggccgtgttaaacatcacacaatcacctaaaacaattttagaatagcagggaaaacagccatctgcatttctacatgacagaaagccaggcagttagttttcattgaaaatggaaagtgttgagaactaggttctctgggagatgacttggctttagcctgtagcagagagatgttggcaggtggccctggctcacctcatcttggaaggaccctcgagtcagagagaatgtacactgagttgagaggagaaaacaaatgggaaactaatgtgtatagagcatcacttatgtgtcaggctctgttatcgttccatataaagctctcagaacaccccagctaggcagttgtgcaaccattttataaaggagaaactgaaccagagacaggttcaataacttgttcagaaactgatgattttaagtggtgaggctggctgggatttgtgctcagtatgtctgactcttgcctatggtcttttc

SEQ ID NO: 333672 - DNA, 328 bp, Homo sapiens
tccaacctaaatgtcttaactttgttctccttcaaatttaaacgggcgtattaatgtgtaacgggagttagtgccccaagccaaggtacactcaagacctgttgcctcagcccagcatgcagaggtggtggggttcagaataggcctccaggaaggagaattgtgccctgtagttggttacgcagaggtcaaaagccagaagcacatggccaatctcctttaagcactttcatttcagctgttcccctctcctgagccatggtgggtccctggcaatgcccggtcttcaatctagtttcatttcttactagctgtgcaacctccatgt

SEQ ID NO: 333673 - DNA, 206 bp, Homo sapiens
agtaagcactgagccatggaccatgcaagaaaagcctcaattcacacctctcacttccttcatggcctaactccaaaaatattacttttcttctgctctaatgtatctttcctgaaattattatgcttttgtagactcattttgtctccccagattgtgagtgatcttaaggcgtggagtccgccctcctccttcctcggtgtttc

SEQ ID NO: 333674 - DNA, 676 bp, Homo sapiens
cagggtgctgtgggagcacagggaagggttcctaactcacactggggatcagggaggctttggctcctgatactaaatgacctcttatttgatacactttttatgtcagacttgctggttctttccacacattgagtcaaagggtgtctctggttcctccctggatggactgatacaggccatttcactcactctcccaagggtttatctcctctggcctctccgagtctcacctggaggtgtgtgttcctgtggcgtgggttccttgggagcgtgggtgattcaccggctggcctcatcccatactgatcctctggggtgatccctattcaccttgtctcctttgctgtcataactccactgctgggggcagaggtggagatgttgagcttgtgggcaggaataagttccactgagccacagagcttgactctgctcaccttcccacaatagaactcagagttggaatcctttccccagccacctcccctcccatctgaggacagagggtaacctgcccgtcatctctggggttatctccaattttcagtctccctcatctccagctgacctcccatatggccaaatcgatcctgaggttgggaatccagttcttcaaactgagcccttcagactctgctgtggtacgtgaaaacagtttcagtatcccgccata

SEQ ID NO: 333675 - DNA, 309 bp, Homo sapiens
ggtcctgctgtagtttttaattaaaacttgttcacactgaacctccagcttggtttaggctttcctaccttggtaatggttcccaaggagctttctgcagttgtaagttgtggttctctgtatcctgaacctgcctgcctctctctctaattttgggggcagtggtttgccctgtgactccaatttctgcaatggctttacgaagagttgttgcttttcacctttgcttttcttttgttttgagtatggaatggcagtttttaactccttaaattccagaccagaaaccggtcatctgcagggctaatt

SEQ ID NO: 333676 - DNA, 361 bp, Homo sapiens
ggaaattgtatggagggacaaacgttcatctaatggaaggcaggtcagataacctggtataaaattgtgctgaaagctccattaacccactacatccgtgactgcgtcctatttttctggttatatcaccaaacttaataccccaaattagaagcacagcatttcagagttcaaagagtacttagcgcctaattcggggcagccctgctgctagtggccattgtggtctaacctccccacatcctgaaatggcccctgctccccgactcccactcagtgtctccgcagctcccgttacactaactcccacgtctcagtctgcctgctggggtcacacagagagggtcaaatgcctctccac

SEQ ID NO: 333677 - DNA, 715 bp, Homo sapiens
ttcattttgggtttctctcttcatgtggttcaaaccaaggttaaaataattatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagatagtttttttatctttcctctcctcctaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaac

SEQ ID NO: 333678 - DNA, 1158 bp, Homo sapiens
gaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggtggggagtccctgctgagggaggttgaatgcccccagagaagtgtcctacagctcctgcctgccagacccccaggcaccctgcagagggaaagttagtgatggcgctggccccacagaaggcttcctgtcaaccttagtgcttcagtgggatcagacccctgggtcaccagccatctgaggaaagcccccacacatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagatagtttttttatctttcctctcctcctaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaac

SEQ ID NO: 333679 - DNA, 512 bp, Homo sapiens
ctatctgaatatataaaatgttagcttttttaaaaagttttttttttctttctatgtggtgtttcctctaggttttattttcttactttttatttgctttggtctttatctttcatcttatagcctttcctcagatagttggtagtcatgtgtaagagtaaggaattaaaatgctaattagaaattctgagcgtggcttgtcaattgttagctttcctgtatggtaacctggctgtggtgtttggttggaggacttctagtgtcggtttcttcttgtatatcctcctagctggttagatccctataagaaggctcttctgatttcttgcttggaattgaaggcctttctacaagcattctgtggggtgggcagtgagggggatgtggaatgaaaggttttgggggatccccagatacgtttcttcactcaaccctgttttcagtatgttctgcattttgctgtgcctgatttccttagtcctgtgatcctatgttttaccttcttcagacaa

SEQ ID NO: 333680 - DNA, 218 bp, Homo sapiens
ctcagtcaatccacccaccttggtctcccaaagtgctgggattaccagtgtgagccactgcgcctggccccaggtcctctttataccctccctggacaacctagcctgcagttccagcctccccagaactcccagagcctctcctggggtcccacatcccctcattatgaatagttagatatatttaatgtactttatacccacatgcatgcaccagg

SEQ ID NO: 333681 - DNA, 80 bp, Homo sapiens
ctttttttttttttttggttttggccaaactttttatttagtattctgtagttgtttaacacacacttaaatggtcttat

SEQ ID NO: 333682 - DNA, 692 bp, Homo sapiens
aaacggaattcttgttaaaatgactgattctcgtgcatgtgaaaggctctggggaatgaatacctgtttggtccaaacttactgtatcataatgctgtatatgttgaaaacgtaatacctgttaatgtcctaatgaatcacgttttgcagaaaacaccgtaagaaacacttcagtctttctgtagtttccatgcatatttcaccatggttcgcactctgatcctcatctggtttagaaagcaattcagtttctttcaaaccaccataacctaagtgctgccccatccttcacctttaccctagaaaatctgagaatccattggtgtgtactgtgtgacacaatgccaacaagcctctggtttctaatactggcaggaccaacacacatactttagtgggaatataatctgtttagacgataatagagggaaatgccataattaacaaatctcccttcactcaccactatcctcattcttgcagttgtcaaggtgtaagcctcactgtaagttacaaagctaccactcccctctttaagaacacatagcttaggattgccttggcgatgtgggctcttttttggttccatatgaacttaagtagttttttccaattctgtgaagaaagtcattggtagcttgatggggatggcattgaatctgtaaattaccttgggcagtatggccattttc

SEQ ID NO: 333683 - DNA, 433 bp, Homo sapiens
tgctgggattaccggcatgagccaccgcgcccggcctatgggaggaagttctgacatggatggcaggggtggggagggcagctgaggactctggagcagaggctggggccccactctggctttccctggccctaaaggaagggtggggtctgagagtgtggaggcctgagagcaggggcagcacagacacccactctgagaccacttggttgtcccagccaccgggttccaggtgtctggggccaggtggggttttctctccaagcccagagtgacctccccactcccagccttgcccagagcaagtcttgctgagttctaaggtgaactcccacttgttccagaccagggacacagggtcctgcaggcctcccggagcaagcactcttgagagggcttctccacgtggccacaggacagactgtgcttcatc

SEQ ID NO: 333684 - DNA, 366 bp, Homo sapiens
ggtgcgctgttacaatcaattagatgttgtgagagccaggcaccccactcccatccccaccgaagttaaaagactctgcacttctggctcctctggaatgccaaggggcagggtttctctgccaccgagtggggccctttcaacccaaagctaaaaagcaaggccaccctccgcgtgccagcattgagctcagtgttcaacccacagttaatacctcacaaaagcccttggatgtgggcctggtcatccccattttacggatgacggagcagaggctccgagagtttaaggggtacatccacgtgagtcacagagcagggtgggcaggagcggggcgtcccacctggtctgcctgagcccagagca

SEQ ID NO: 333685 - DNA, 366 bp, Homo sapiens
aaccagctctgagcagagtgttatcattatcttaatcacactgctctggaatttatcatattctggaaatcacatttgcttaaaattacatctatgtcatttatggttatggttgatgaatatcccatgaaccctttattgagttactgaaatgagtatgttaatccccattgaaaaaaggtgtggcccaaacaaagcaagatgcttcttcagaattgtatttattaatatttaagggtgatatttctgcctttctgatatgaaaatccatcaaagtgcttacgttgtgaatagattactttttgagatgccgcctactttgactcaaagctctgtaattgtgctatttaaatcaaataaattgaa

SEQ ID NO: 333686 - DNA, 3527 bp, Homo sapiens
aaaagcgtgggcagttggagaagaagcagccagagtgtgaagaagcccacggaagggaagtccaggaggaggaaaagaagcagaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaataatatggcctcccaacaaaacacagacaacctggtcaccgagcaagtacgaggtcaggagcagactcctggggaaggtttcatccaggttcgttatggccagaagcctgaggtgcccaatggagtctcaccaggtcaccgccttccccatggctatcatagtgacaagcgacgtcttagtaaggccagcagcaaggcaaggtcagatgacctatcagtgtgaccctcctttatgggaggatcaggaccaggtgggaacaaaggaggctcagagaagaaagacgtgtcccttctgaactgatgctttctcactgtcatcactgcttggctcctttgagccccgggtctcaatgacgttgctcattaattctagaaactataaccagggctctgggatagtaagagaggtgacaacccacccagactgcagttccctccccaccctctacccagtatacgaagcctttcagattactcatgaaacagggtagagggaaagaagggaagcatggcaaaagctggcctggaagggatagccagagggatagaatgactctctctctacataccagcagcataccaaatgcgttctctaagttcctacctccttgacctgatcaccctccctcctccaaggaagagctcaaagttcccagccaatagacagcatgaatcaaggaacttgcattatatgtgctcttgaatctgttgtctccatggaccattcctcggagtagtggtgagatggccttgggttgcccttggcttctcctccctctactcagccttaaaaagggcttcttggaactttaccagcagcctcagctttacaaatgccttggtatgtacctctggcaaatgccccaccttggtgatgttgcaacctttccttctgctagggtgtacacctagcctgtgcaggtgtcagccctgctagggagtcactgtacacacaaactctactggaattcctgccaacatctgtcaccctgcagctcctttacagttcaatccaatgatagaaaccatcccttccctttctcccttggctgttcacccagccattccctgaaggccttaccaacaggaatatccaagaagctgttgtcctctctcgaaccctgaccagatcatcagccactgaggccagtggaatttccccaggccttgttaaaacaaagaaagcattgtacttctcagattccccttgtggaaaaaaaaattctgctgtgaagatgaaaataaaaatggagagaaaacactggaaaactattttcccctcctatttacttcctttgctgactgccaacttagtgccaagaggaggtgtgatgacagctatggaggcccccagatctctctctcctggaggctttagcaggggcaaggaaatagtaggggaatctccagctctcttggcagggcctttatttaaagagcgcagagattcctatgtctccctagtgcccctaatgagactgccaagtgggggctgtagaaaagccttgccttccccagggattggcctggtctctgtattcactggatccataatgggttgctgttgttttggatgaaggtaaacgatgcttggaattggaaactgagacttatagagggattattacattattaaaatgcacgtgtgtgtgtgtgtgggtgctgatgggatgggtaaaggcttggggagtcctgaaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaaagataaatgagagtggagaggtggaggaaagtgactaggatgccatttaggaaggaatgtctgatcatcccgggtccctggaggggacaccttttaatctattgcctagcattaatattttctctccttctatctctgaaatgttttatgaaatgagtgttcttgaattagaaattctgtgggatcaatctttgatggtgagggttttagaaaggaaaaatatagtaaaatgtgtaatttgtcttaataaaatctatctctacatctatctctcttttgttgtccacttcatactgtgactacaagagaaggatggcagacttggtggggaggggagcgcttggactatacccatcagtaagccagtaatgcaaagagctttgaagtcaggcatgcaatggttaaaattccagttgttaacttacatctggactccagcaagacaatctctgagccttggtttcttcatctgtaaactgggccccattaatatctacctcatggggctgttaactgagctgttaagtacctcatagggctgttaactgagttgactgtaaagagtttagcagagtgcttgggaaataacagtcattacatggtaattgttgttattatctgattatttttgttattgttttgaatacacagtatttgaaaatgg

SEQ ID NO: 333687 - DNA, 3211 bp, Homo sapiens
cagtctccattttcaaacagtccctcctgggagaacacagacaggcagaggattacaacacaaggcagcaagcactgggagacgaaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaataatatggcctcccaacaaaacacagacaacctggtcaccgagcaagtacgaggtcaggagcagactcctggggaaggtttcatccaggttcgttatggccagaagcctgaggtgcccaatggagtctcaccaggtcaccgccttccccatggctatcatagtgacaagcgacgtcttagtaaggccagcagcaaggcaaggtcagatgacctatcagtgtgaccctcctttatgggaggatcaggaccaggtgggaacaaaggaggctcagagaagaaagacgtgtcccttctgaactgatgctttctcactgtcatcactgcttggctcctttgagccccgggtctcaatgacgttgctcattaattctagaaactataaccagggctctgggatagtaagagaggtgacaacccacccagactgcagttccctccccaccctctacccagtatacgaagcctttcagattactcatgaaacagggtagagggaaagaagggaagcatggcaaaagctggcctggaagggatagccagagggatagaatgactctctctctacataccagcagcataccaaatgcgttctctaagttcctacctccttgacctgatcaccctccctcctccaaggaagagctcaaagttcccagccaatatctgtcaccctgcagctcctttacagttcaatccaatgatagaaaccatcccttccctttctcccttggctgttcacccagccattccctgaaggccttaccaacaggaatatccaagaagctgttgtcctctctcgaaccctgaccagatcatcagccactgaggccagtggaatttccccaggccttgttaaaacaaagaaagcattgtacttctcagattccccttgtggaaaaaaaaattctgctgtgaagatgaaaataaaaatggagagaaaacactggaaaactattttcccctcctatttacttcctttgctgactgccaacttagtgccaagaggaggtgtgatgacagctatggaggcccccagatctctctctcctggaggctttagcaggggcaaggaaatagtaggggaatctccagctctcttggcagggcctttatttaaagagcgcagagattcctatgtctccctagtgcccctaatgagactgccaagtgggggctgtagaaaagccttgccttccccagggattggcctggtctctgtattcactggatccataatgggttgctgttgttttggatgaaggtaaacgatgcttggaattggaaactgagacttatagagggattattacattattaaaatgcacgtgtgtgtgtgtgtgggtgctgatgggatgggtaaaggcttggggagtcctgaaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaaagataaatgagagtggagaggtggaggaaagtgactaggatgccatttaggaaggaatgtctgatcatcccgggtccctggaggggacaccttttaatctattgcctagcattaatattttctctccttctatctctgaaatgttttatgaaatgagtgttcttgaattagaaattctgtgggatcaatctttgatggtgagggttttagaaaggaaaaatatagtaaaatgtgtaatttgtcttaataaaatctatctctacatctatctctcttttgttgtccacttcatactgtgactacaagagaaggatggcagacttggtggggaggggagcgcttggactatacccatcagtaagccagtaatgcaaagagctttgaagtcaggcatgcaatggttaaaattccagttgttaacttacatctggactccagcaagacaatctctgagccttggtttcttcatctgtaaactgggccccattaatatctacctcatggggctgttaactgagctgttaagtacctcatagggctgttaactgagttgactgtaaagagtttagcagagtgcttgggaaataacagtcattacatggtaattgttgttattatctgattatttttgttattgttttgaatacacagtatttgaaaatgg

SEQ ID NO: 333688 - DNA, 2947 bp, Homo sapiens
cagtctccattttcaaacagtccctcctgggagaacacagacaggcagaggattacaacacaaggcagcaagcactgggagacgaaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaataatatggcctcccaacaaaacacagacaacctgatcaccctccctcctccaaggaagagctcaaagttcccagccaatagacagcatgaatcaaggaacttgcattatatgtgctcttgaatctgttgtctccatggaccattcctcggagtagtggtgagatggccttgggttgcccttggcttctcctccctctactcagccttaaaaagggcttcttggaactttaccagcagcctcagctttacaaatgccttggtatgtacctctggcaaatgccccaccttggtgatgttgcaacctttccttctgctagggtgtacacctagcctgtgcaggtgtcagccctgctagggagtcactgtacacacaaactctactggaattcctgccaacatctgtcaccctgcagctcctttacagttcaatccaatgatagaaaccatcccttccctttctcccttggctgttcacccagccattccctgaaggccttaccaacaggaatatccaagaagctgttgtcctctctcgaaccctgaccagatcatcagccactgaggccagtggaatttccccaggccttgttaaaacaaagaaagcattgtacttctcagattccccttgtggaaaaaaaaattctgctgtgaagatgaaaataaaaatggagagaaaacactggaaaactattttcccctcctatttacttcctttgctgactgccaacttagtgccaagaggaggtgtgatgacagctatggaggcccccagatctctctctcctggaggctttagcaggggcaaggaaatagtaggggaatctccagctctcttggcagggcctttatttaaagagcgcagagattcctatgtctccctagtgcccctaatgagactgccaagtgggggctgtagaaaagccttgccttccccagggattggcctggtctctgtattcactggatccataatgggttgctgttgttttggatgaaggtaaacgatgcttggaattggaaactgagacttatagagggattattacattattaaaatgcacgtgtgtgtgtgtgtgggtgctgatgggatgggtaaaggcttggggagtcctgaaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaaagataaatgagagtggagaggtggaggaaagtgactaggatgccatttaggaaggaatgtctgatcatcccgggtccctggaggggacaccttttaatctattgcctagcattaatattttctctccttctatctctgaaatgttttatgaaatgagtgttcttgaattagaaattctgtgggatcaatctttgatggtgagggttttagaaaggaaaaatatagtaaaatgtgtaatttgtcttaataaaatctatctctacatctatctctcttttgttgtccacttcatactgtgactacaagagaaggatggcagacttggtggggaggggagcgcttggactatacccatcagtaagccagtaatgcaaagagctttgaagtcaggcatgcaatggttaaaattccagttgttaacttacatctggactccagcaagacaatctctgagccttggtttcttcatctgtaaactgggccccattaatatctacctcatggggctgttaactgagctgttaagtacctcatagggctgttaactgagttgactgtaaagagtttagcagagtgcttgggaaataacagtcattacatggtaattgttgttattatctgattatttttgttattgttttgaatacacagtatttgaaaatgg

SEQ ID NO: 333689 - DNA, 1653 bp, Homo sapiens
cgcatcttcgtcccatcaggatctataacctatttatttagatagaagtggcagtgaatcatattcatttgttatattcaagttggcagtattttattattgggacaaccataataatccttagcatatatgctgatgggggcaagactgcccagtcttgctcccatcaggccttaccaacaggaatatccaagaagctgttgtcctctctcgaaccctgaccagatcatcagccactgaggccagtggaatttccccaggccttgttaaaacaaagaaagcattgtacttctcagattccccttgtggaaaaaaaaattctgctgtgaagatgaaaataaaaatggagagaaaacactggaaaactattttcccctcctatttacttcctttgctgactgccaacttagtgccaagaggaggtgtgatgacagctatggaggcccccagatctctctctcctggaggctttagcaggggcaaggaaatagtaggggaatctccagctctcttggcagggcctttatttaaagagcgcagagattcctatgtctccctagtgcccctaatgagactgccaagtgggggctgtagaaaagccttgccttccccagggattggcctggtctctgtattcactggatccataatgggttgctgttgttttggatgaaggtaaacgatgcttggaattggaaactgagacttatagagggattattacattattaaaatgcacgtgtgtgtgtgtgtgggtgctgatgggatgggtaaaggcttggggagtcctgaaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaaagataaatgagagtggagaggtggaggaaagtgactaggatgccatttaggaaggaatgtctgatcatcccgggtccctggaggggacaccttttaatctattgcctagcattaatattttctctccttctatctctgaaatgttttatgaaatgagtgttcttgaattagaaattctgtgggatcaatctttgatggtgagggttttagaaaggaaaaatatagtaaaatgtgtaatttgtcttaataaaatctatctctacatctatctctcttttgttgtccacttcatactgtgactacaagagaaggatggcagacttggtggggaggggagcgcttggactatacccatcagtaagccagtaatgcaaagagctttgaagtcaggcatgcaatggttaaaattccagttgttaacttacatctggactccagcaagacaatctctgagccttggtttcttcatctgtaaactgggccccattaatatctacctcatggggctgttaactgagctgttaagtacctcatagggctgttaactgagttgactgtaaagagtttagcagagtgcttgggaaataacagtcattacatggtaattgttgttattatctgattatttttgttattgttttgaatacacagtatttgaaaatgg

SEQ ID NO: 333690 - DNA, 954 bp, Homo sapiens
  misc_feature (937)..(937): n is a, c, g, or t
aaaagcgtgggcagttggagaagaagcagccagagtgtgaagaagcccacggaagggaagtccaggaggaggaaaagaagcagaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccacctcatttccacccgacctcaattnaggatcctctagatcta

SEQ ID NO: 333691 - DNA, 3529 bp, Homo sapiens
cagtctccattttcaaacagtccctcctgggagaacacagacaggcagaggattacaacacaaggcagcaagcactgggagacgaaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaataatatggcctcccaacaaaacacagacaacctggtcaccgagcaagtacgaggtcaggagcagactcctggggaaggtttcatccaggttcgttatggccagaagcctgaggtgcccaatggagtctcaccaggtcaccgccttccccatggctatcatagtgacaagcgacgtcttagtaaggccagcagcaaggcaaggtcagatgacctatcagtgtgaccctcctttatgggaggatcaggaccaggtgggaacaaaggaggctcagagaagaaagacgtgtcccttctgaactgatgctttctcactgtcatcactgcttggctcctttgagccccgggtctcaatgacgttgctcattaattctagaaactataaccagggctctgggatagtaagagaggtgacaacccacccagactgcagttccctccccaccctctacccagtatacgaagcctttcagattactcatgaaacagggtagagggaaagaagggaagcatggcaaaagctggcctggaagggatagccagagggatagaatgactctctctctacataccagcagcataccaaatgcgttctctaagttcctacctccttgacctgatcaccctccctcctccaaggaagagctcaaagttcccagccaatagacagcatgaatcaaggaacttgcattatatgtgctcttgaatctgttgtctccatggaccattcctcggagtagtggtgagatggccttgggttgcccttggcttctcctccctctactcagccttaaaaagggcttcttggaactttaccagcagcctcagctttacaaatgccttggtatgtacctctggcaaatgccccaccttggtgatgttgcaacctttccttctgctagggtgtacacctagcctgtgcaggtgtcagccctgctagggagtcactgtacacacaaactctactggaattcctgccaacatctgtcaccctgcagctcctttacagttcaatccaatgatagaaaccatcccttccctttctcccttggctgttcacccagccattccctgaaggccttaccaacaggaatatccaagaagctgttgtcctctctcgaaccctgaccagatcatcagccactgaggccagtggaatttccccaggccttgttaaaacaaagaaagcattgtacttctcagattccccttgtggaaaaaaaaattctgctgtgaagatgaaaataaaaatggagagaaaacactggaaaactattttcccctcctatttacttcctttgctgactgccaacttagtgccaagaggaggtgtgatgacagctatggaggcccccagatctctctctcctggaggctttagcaggggcaaggaaatagtaggggaatctccagctctcttggcagggcctttatttaaagagcgcagagattcctatgtctccctagtgcccctaatgagactgccaagtgggggctgtagaaaagccttgccttccccagggattggcctggtctctgtattcactggatccataatgggttgctgttgttttggatgaaggtaaacgatgcttggaattggaaactgagacttatagagggattattacattattaaaatgcacgtgtgtgtgtgtgtgggtgctgatgggatgggtaaaggcttggggagtcctgaaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaaagataaatgagagtggagaggtggaggaaagtgactaggatgccatttaggaaggaatgtctgatcatcccgggtccctggaggggacaccttttaatctattgcctagcattaatattttctctccttctatctctgaaatgttttatgaaatgagtgttcttgaattagaaattctgtgggatcaatctttgatggtgagggttttagaaaggaaaaatatagtaaaatgtgtaatttgtcttaataaaatctatctctacatctatctctcttttgttgtccacttcatactgtgactacaagagaaggatggcagacttggtggggaggggagcgcttggactatacccatcagtaagccagtaatgcaaagagctttgaagtcaggcatgcaatggttaaaattccagttgttaacttacatctggactccagcaagacaatctctgagccttggtttcttcatctgtaaactgggccccattaatatctacctcatggggctgttaactgagctgttaagtacctcatagggctgttaactgagttgactgtaaagagtttagcagagtgcttgggaaataacagtcattacatggtaattgttgttattatctgattatttttgttattgttttgaatacacagtatttgaaaatgg

SEQ ID NO: 333692 - DNA, 3172 bp, Homo sapiens
cagtctccattttcaaacagtccctcctgggagaacacagacaggcagaggattacaacacaaggcagcaagcactgggagacgaaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaataatatggcctcccaacaaaacacagacaacctggtcaccgagcaagtacgaggtcaggagcagactcctggggaaggtttcatccaggttcgttatggccagaagcctgaggtgcccaatggagtctcaccaggtcaccgccttccccatggctatcatagtgacaagcgacgtcttagtaaggccagcagcaaggcaaggtcagatgacctatcagtgtgaccctcctttatgggaggatcaggaccaggtgggaacaaaggaggctcagagaagaaagacgtgtcccttctgaactgatgctttctcactgtcatcactgcttggctcctttgagccccgggtctcaatgacgttgctcattaattctagaaactataaccagggctctgggatagtaagagaggtgacaacccacccagactgcagttccctccccaccctctacccagtatacgaagcctttcagattactcatgaaacagggtagagggaaagaagggaagcatggcaaaagctggcctggaagggatagccagagggatagaatgactctctctctacataccagcagcataccaaatgcgttctctaagttcctacctccttgacctgatcaccctccctcctccaaggaagagctcaaagttcccagccaatagacagcatgaatcaaggaacttgcattatatgtgctcttgaatctgttgtctccatggaccattcctcggagtagtggtgagatggccttgggttgcccttggcttctcctccctctactcagccttaaaaagggcttcttggaactttaccagcagcctcagctttacaaatgccttggtatgtacctctggcaaatgccccaccttggtgatgttgcaacctttccttctgctagggtgtacacctagcctgtgcaggtgtcagccctgctagggagtcactgtacacacaaactctactggaattcctgccaacatctgtcaccctgcagctcctttacagttcaatccaatgatagaaaccatcccttccctttctcccttggctgttcacccagccattccctgaaggccttaccaacaggaatatccaagaagctgttgtcctctctcgaaccctgaccagatcatcagccactgaggccagtggaatttccccaggccttgttaaaacaaagaaagcattgtacttctcagattccccttgtggaaaaaaaaattctgctgtgaagatgaaaataaaaatggagagaaaacactggaaaactattttcccctcctatttacttcctttgctgactgccaacttagtgccaagaggaggtgtgatgacagctatggaggcccccagatctctctctcctggaggctttagcaggggcaaggaaatagtaggggaatctccagctctcttggcagggcctttatttaaagagcgcagagattcctatgtctccctagtgcccctaatgagactgccaagtgggggctgtagaaaagccttgccttccccagggattggcctggtctctgtattcactggatccataatgggttgctgttgttttggatgaaggtaaacgatgcttggaattggaaactgagacttatagagggattattacattattaaaatgcacgtgtgtgtgtgtgtgggtgctgatgggatgggtaaaggcttggggagtcctgaaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaaagataaatgagagtggagaggtggaggaaagtgactaggatgccatttaggaaggaatgtctgatcatcccgggtccctggaggggacaccttttaatctattgcctagcattaatattttctctccttctatctctgaaatgttttatgaaatgagtgttcttgaattagaaattctgtgggatcaatctttgatggtgagggttttagaaaggaaaaatatagtaaaatgtgtaatttgtcttaataaaatctatctctacatcatgaacaatcacatcatgaacaatcacatcatgaacaatca

SEQ ID NO: 333693 - DNA, 2644 bp, Homo sapiens
aaaagcgtgggcagttggagaagaagcagccagagtgtgaagaagcccacggaagggaagtccaggaggaggaaaagaagcagaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaacctttccttctgctagggtgtacacctagcctgtgcaggtgtcagccctgctagggagtcactgtacacacaaactctactggaattcctgccaacatctgtcaccctgcagctcctttacagttcaatccaatgatagaaaccatcccttccctttctcccttggctgttcacccagccattccctgaaggccttaccaacaggaatatccaagaagctgttgtcctctctcgaaccctgaccagatcatcagccactgaggccagtggaatttccccaggccttgttaaaacaaagaaagcattgtacttctcagattccccttgtggaaaaaaaaattctgctgtgaagatgaaaataaaaatggagagaaaacactggaaaactattttcccctcctatttacttcctttgctgactgccaacttagtgccaagaggaggtgtgatgacagctatggaggcccccagatctctctctcctggaggctttagcaggggcaaggaaatagtaggggaatctccagctctcttggcagggcctttatttaaagagcgcagagattcctatgtctccctagtgcccctaatgagactgccaagtgggggctgtagaaaagccttgccttccccagggattggcctggtctctgtattcactggatccataatgggttgctgttgttttggatgaaggtaaacgatgcttggaattggaaactgagacttatagagggattattacattattaaaatgcacgtgtgtgtgtgtgtgggtgctgatgggatgggtaaaggcttggggagtcctgaaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaaagataaatgagagtggagaggtggaggaaagtgactaggatgccatttaggaaggaatgtctgatcatcccgggtccctggaggggacaccttttaatctattgcctagcattaatattttctctccttctatctctgaaatgttttatgaaatgagtgttcttgaattagaaattctgtgggatcaatctttgatggtgagggttttagaaaggaaaaatatagtaaaatgtgtaatttgtcttaataaaatctatctctacatctatctctcttttgttgtccacttcatactgtgactacaagagaaggatggcagacttggtggggaggggagcgcttggactatacccatcagtaagccagtaatgcaaagagctttgaagtcaggcatgcaatggttaaaattccagttgttaacttacatctggactccagcaagacaatctctgagccttggtttcttcatctgtaaactgggccccattaatatctacctcatggggctgttaactgagctgttaagtacctcatagggctgttaactgagttgactgtaaagagtttagcagagtgcttgggaaataacagtcattacatggtaattgttgttattatctgattatttttgttattgttttgaatacacagtatttgaaaatgg

SEQ ID NO: 333694 - DNA, 395 bp, Homo sapiens
cttgtgatccgcctgcctgggcctcccaaagtgctgggattacaggtgtgagctacgcctcagtgccaaactggtaccaggtgctctgctgggtttgtttcagcggatggtcagccagcccatgggtggatgctgtcattattgccattttacagtgggggaaactgaggcacatggggctgaaaaacctgcctgaggtcatactgccagaggtgggaaagctgggatccagcaggccctgtctggttcctgtctgcttccaggatctcagggcttggatgattcctgccttcagggaccattagtcagaaaggaaaacttaaaagggaggggacccagtggactctaaggccaacaagccatgggtgaggtatggatgagtcaggattctggac

SEQ ID NO: 333695 - DNA, 495 bp, Homo sapiens
tgaaacctgctcaatggaagtacctactctattggttgcttcccatatggttgtcactgtaccttcatactgcctcatttgaccctcatattagccctgtacagtagatgggtacactggtttgccaaaggagacctggaatccaaggtggaagtaagcagcaaagccagaaacttcaattctggtctgtctaccttgatagcctgcaccctcccctctaccgttttcttccactatttttgattccttaatgatgaatcatcctctcccttctagttggatttgtttctaatggcttccattacaaggataataatgaaactggtgaaaactttcaggcaaaaggattttctttttatattttttcttattattttttaattattaaccaaattaactcattacagtaaaaaggactgatttttaagccagctgtgatagctctgtaatagtctgtaatctcagcactttgggaggccaaggcgggcagatcgc

SEQ ID NO: 333696 - DNA, 2444 bp, Homo sapiens
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 333697 - DNA, 2378 bp, Homo sapiens
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 333698 - DNA, 2085 bp, Homo sapiens
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagtcaactgcattcagagagctcaatgtctgagttatctttggacaggcttaatccacttcttgacatc

SEQ ID NO: 333699 - DNA, 2341 bp, Homo sapiens
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacaacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 333700 - DNA, 1641 bp, Homo sapiens
taacagattcaaatacactaaaactctcccagagttaaatgttgttttcccactctggaaaagggaaattatggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 333701 - DNA, 987 bp, Homo sapiens
gttacaggagcttcaaaggatttattgggtcaaacttactgcactatgaaaagcaatagatcgtccataagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 333702 - DNA, 1531 bp, Homo sapiens
  misc_feature (1397)..(1397): n is a, c, g, or t
  misc_feature (1404)..(1404): n is a, c, g, or t
  misc_feature (1441)..(1441): n is a, c, g, or t
  misc_feature (1492)..(1492): n is a, c, g, or t
  misc_feature (1504)..(1504): n is a, c, g, or t
  misc_feature (1522)..(1522): n is a, c, g, or t
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgaactttnggggatnattgcctacctattgaacagaaaatttgaaaatctcntcaaatttttaaataatgtttttgtttaagtaattttgggaaattattttnccctgaaagggnaaaaaaatttttgggttntttaactta

SEQ ID NO: 333703 - DNA, 1077 bp, Homo sapiens
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgcaatgagagatttcgtaaagagtgttttagatcaccccctccccaatgagagattt

SEQ ID NO: 333704 - DNA, 757 bp, Homo sapiens
aagaagatagtggtgagctggcaaagccaaagattggttttccagagacaacagaagaggagctaggtaaatgctatggaattgacttttgtaagagtcttgggggatttaaaattgaactgtaacagaagttttactcattggcagaagaaatttattaaatatgaacatatttaaataatggaaactttaaatatttatgcatgtatatatacatatttataagctaaatatttaaatacctactgcatagtagtaataggcacagagatgtagtatggacacaaccgatgtggttactctttcagagctagagtctaacttaggagacatgccaaaacacaaattattgtaagggggattaaaaaaagcttcctagagaagtgacatttaaactgggaactaaggatgagcagaaatgatttaggtgaggtcatgagagggggtgttggtagggacaggatggaaaagttcatagcaggaaaactatgttaactaaaagttcagaaccaaaaaggagcatagcatatgaggaactaaaagaacttctccatgcctccaggttaaagagcaaaggcaaagtgaagctggagaagctagatcatctgagggcctcatttgctgtattaggacttggagagttttatactaagagcaatgagaaacctttgaattttaagaagaggactttaaaagattgccttggtagttcaagaccaacctggccaacatggtgaaaccctgtctctactaaaaa

SEQ ID NO: 333705 - DNA, 2888 bp, Homo sapiens
  misc_feature (2544)..(2544): n is a, c, g, or t
  misc_feature (2888)..(2888): n is a, c, g, or t
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaaaaaaaaaaaccgggggctcaatgcgggggcgggaaggggtaggaagggcccggtcctagggttccggacccagttttgtgtccaggggggaattgggggngccccataggaggcagataaatggatagcagacacgtatcatacgacacacagcacacgaacagagcgcgaatacatcaccggggcaacagaacaacacacgacgagacacaaacacagcagaggacgactgactagtcggagcgcgacataaaggtagagtctaccccgtctggaaacggggacgacagaggacggagcgcgccgctgcaacacgagcctgagacacagcaaacagtggacggagcgaaagcagagacagcggacgacggcgcgcacgatcggcggcaggcacgcagcgagagcacgcactaacggacatgcgcagcgagagcaggacgcagn

SEQ ID NO: 333706 - DNA, 2387 bp, Homo sapiens
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 333707 - DNA, 2308 bp, Homo sapiens
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagcaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 333708 - DNA, 2453 bp, Homo sapiens
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcagcggatagtaacattattgttaccccgggcgacacggatacaccttgtaacgcatctatgcacttgaccaacccgtgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 333709 - DNA, 1005 bp, Homo sapiens
tgcacacgccgaaggtccagctactacttcgtccatcacgatctctgtccaggtctggtgcctcggcgtgtgcatgcacacgccgaatctttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 333710 - DNA, 1819 bp, Homo sapiens
aatacatggtctcgctctgttgcccaggctggagtgcggtggcgcgagcaccgcttactgcggtgtcgacctctcgggctcgagttatcctcccacctcagccttccaagtaggtgggaccacaggcaccaccactccaagcccgtatatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacggtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagcgtaagtgtagccaagatggctaactttggtgttctctgtagcttgtgtcctgaaataatcaaaaacttcagtgtcagatattcataaaattctgactcactggctgccatacagaacgcatgtttgatcccaccaaaattccatcgtggtccatcgtggtcctgtgtgcttctttgtcttcagtggttctcaaaattttcagaggcctaaatgacttattccgtatattttgattgagactcaggaatctgcattaacaaacgcaccagataatgaatgttgatctcctttacgaatgctgctctgtgtgtactccttagtgatatcctacattgatggccctaggtttttatttcaatcccggtttttgttaactggctttaggcatcattaaaactcattgtgtcaaaaacaaacaaacaaaaaaacaacaaaaaaacaaaactcagctgctcgtcatttcctaagtttttaaaggttgaaatctaaagcattcttgattttcccttatatctagattatcatcatcttttttgattctgccagcgggatgtctcctgactccaatgttccttcatgtagtaactgtggctgccttagttcaggatcatttttaactttcagtagtttcttttcctcctattcattttccatattgttgccagttgtcttcctaaaaac

SEQ ID NO: 333711 - DNA, 7602 bp, Homo sapiens
  misc_feature (2)..(2): n is a, c, g, or t
  misc_feature (4)..(6): n is a, c, g, or t
  misc_feature (10)..(10): n is a, c, g, or t
  misc_feature (12)..(14): n is a, c, g, or t
  misc_feature (16)..(18): n is a, c, g, or t
tngnnnggcngnnngnnnaggtagacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333712 - DNA, 541 bp, Homo sapiens
cagtaggcaacaaaccaggaactgtcctggcagataagacagactgtgcaaggtcatcgtcatcggcatgggaagggcattaattaccaaagtggagacacagtcactgtctccaagagcatttggaatcacttcacagagttctcaaggaggggaaggctatctgtcagctcctggcgggactgctgccccatatactgtgatgaattgcttcacatatctgagttctgatgggaaggagtccaagtgcggtagctgtagagaacgctggggaagcccagttctgtgtagctcacgtatgaaaggaatattcatgaagagcaaaacagaggcattatttgagattaactgcctgagaaacctagtctaatcccaagtgtctagaaaatgttgactacttgccatgtgcccagtaaggtgcttggagctttatatgcatcctctcatttaaccctgtgacatagttatgctggtacaccttgctgcgttctgtacatgaagaagttgaagctcaaggaagttaaaagaaaaagagaatgga

SEQ ID NO: 333713 - DNA, 814 bp, Homo sapiens
gtcctgcgggcggcgtccccgcaccgggagccggagggggccggggccgggcgggcgctccggggctgccttcttccccgcgccctgcggggctgtccaacgccttccagctccggctcccgctgcctgcaccatgtccgccagagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaagagatggtggcagctgtaggcagagagtggaccactgacaaccagaagaggaagacgaatgatcctggctcctcagagaatttctaatggagttttctcctctactggcattccatttttccttgccacaaatcctgagttccctctcttgctggctgaaatacattcctttctgttggcagaaaccaatttgacagtgcagcaagctgtgggctatgattcatactaatacaaacca

SEQ ID NO: 333714 - DNA, 495 bp, Homo sapiens
tgcctgtaatttccattatcttctaatgtttaccttcatcccaatacatagtaagttagtgttctgccactcaacaaagcccccctaaggctcagtgctacctgagacactggtggaaagttgagaatgtctaagattctgtccctgtcccctggaaactggagcttccactggccttgcagaaggaagacccatcactcgaattctgtcatgacagtctcttggaagctctatcttgggagtactagcgtttaggtggattctgcttgttaataaaatggactgtggtgttctagaagaggtgttttctttcttctcagatatttccatatgaaatgctcatggtgaccaacagagggcgaaacaaaatcctcagagaggtggacagaaccaggctggaggtaaaacaaaaccgaaaaatccagtcccaactgcagatccctatgcactcccccaactctcccctaagcaatgttttatttcttcagtgaaaac

SEQ ID NO: 333715 - DNA, 685 bp, Homo sapiens
agtagctggaataacaggtgtgtgccaccacacctggctaatcttttgtatttttggtagagacagggtttcactatgttggccaggctggtctctaactcctgacctcgtgatctgcctgcctgggcctcccaaagtgctgggattacagacatgagccaccgcacccggccagtatcagggtatcttaactggtgaaagccacaagtggcagggaagcccaccattgtactgcccatcccccgggagtgtttgtgccaactaataattctgtttaccgaactcacatggtataagaaaatgaggtcgtggaagccagtttaagagaaggatcattttggacaactaatgactgggtaactgtgtatgtagcttcaagtagctgccacttgccacagcaggaaatgggcctttagtggcccaccctcaggaccctcaccacccatcagagaagcctgtcattcactgccataaatgtggggagccttgcaagggtgaagtgcttcgggtccagaccaaacatttccacatcaagtgtttcacctgcaaagaaacttctagaccatttagaaaagaccaaggaccaaggagactgcccagagaatcaagattgttcagccaaattgtctgttttcagtgatcctttcctgggctgtcccatatataaaatcaactactccctata

SEQ ID NO: 333716 - DNA, 6894 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333717 - DNA, 7604 bp, Homo sapiens
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333718 - DNA, 7654 bp, Homo sapiens
agtagctggaataacaggtgtgtgccaccacacctggctaatcttttgtatttttggtagagacagggtttcactatgttggccaggctggtctctaactcctgacctcgtgatctgcctgcctgggcctcccaaagtgctgggattacagacatgagccaccgcacccggccagtatcagggtatcttaactggtgaaagccacaagtggcagggaagcccaccattgtactgcccatcccccgggagtgtttgtgccaactaataattctgtttaccgaactcacatggtataagaaaatgaggtcgtggaagccagtttaagagaaggatcattttggacaactaatgactgggtaactgtgtatgtagcttcaagtagctgccacttgccacagcaggaaatgggcctttagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333719 - DNA, 6711 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcgggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333720 - DNA, 7630 bp, Homo sapiens
  misc_feature (2)..(2): n is a, c, g, or t
  misc_feature (4)..(6): n is a, c, g, or t
  misc_feature (10)..(10): n is a, c, g, or t
  misc_feature (12)..(14): n is a, c, g, or t
  misc_feature (16)..(18): n is a, c, g, or t
tngnnnggcngnnngnnnaggtagacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtaaaaaaaaaaacacacaatacaaaaaaac

SEQ ID NO: 333721 - DNA, 6810 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggtaaagcggacattgcacaaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333722 - DNA, 6875 bp, Homo sapiens
ctcccagtgggtgtgcagacactggagagacccagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333723 - DNA, 6028 bp, Homo sapiens
gccatggataatggtaataaacagaactttctggaactgaaacttttgccagagaacaagaaaactatgtaagtggggttgtaccgccattgtcttacagaccaatagctaagcaacccctgattcccatctagatgcagctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333724 - DNA, 5660 bp, Homo sapiens
tgcctgtaatttccattatcttctaatgtttaccttcatcccaatacatagtaagttagtgttctgccactcaacaaagcccccctaaggctcagtgctacctgagacactggtggaaagttgagaatgtctaagattctgtccctgtcccctggaaactggagcttccactggccttgcagaaggaagacccatcactcgaattctgtcatgacagtctcttggaagctctatcttgggagtactagcgtttaggtggattctgcttgttaataaaatggactgtggtgttctagaagaggtgttttctttcttctcagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333725 - DNA, 3682 bp, Homo sapiens
tatgcttcgcgttaatggtttcatatgcacgcacgtgttggggaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333726 - DNA, 2822 bp, Homo sapiens
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333727 - DNA, 6802 bp, Homo sapiens
  misc_feature (2)..(2): n is a, c, g, or t
  misc_feature (4)..(6): n is a, c, g, or t
  misc_feature (10)..(10): n is a, c, g, or t
  misc_feature (12)..(14): n is a, c, g, or t
  misc_feature (16)..(18): n is a, c, g, or t
tngnnnggcngnnngnnnaggtagacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggtacagattaaatacaggttaaatagctacc

SEQ ID NO: 333728 - DNA, 4438 bp, Homo sapiens
  misc_feature (2)..(2): n is a, c, g, or t
  misc_feature (4)..(6): n is a, c, g, or t
  misc_feature (10)..(10): n is a, c, g, or t
  misc_feature (12)..(14): n is a, c, g, or t
  misc_feature (16)..(18): n is a, c, g, or t
tngnnnggcngnnngnnnaggtagacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcatcctttgtcatatactctgcatcactgtcatactcacaacttcgtgaataaagttgtgtgctttattcgta

SEQ ID NO: 333729 - DNA, 968 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgtactgtttgaagtcatccttttgttgttaatttaagaataaaattctcagcatttgaaaaaaaaaaa

SEQ ID NO: 333730 - DNA, 1348 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagaaaaaacctacagtgtctaagaatgaagaaagctaaagtctgatgggcacactggaactgaagctgtagggcccaaagggttctggatctcagataagcatctgagattacagttctgttgcctcacataaattttaggagataagatctcagaatcatgggaggcagcagctctagaagtgacactcttacaaagaaactccagagcttacag

SEQ ID NO: 333731 - DNA, 942 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgttaaatttccgggcgcccttttaacaggtgggctctaagtgagcgctctctgtgcgcgggcttttgcgctcttttgcgtcgctctaact

SEQ ID NO: 333732 - DNA, 1106 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggtaaagcggacattgcacaaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgtaagggtgactgttcctggattcactctatataacaaactatgtttctgtgattttttcccctactattgatagcacattgaaaaatcaacgactaaacatttccatccctctcccagagcaaaatgaaaactggtatccaactatattttatgctctatcttttcttgaaacatcagtcatcctaagcctgtgttcattttgatttattaaataattatattttgacagcg

SEQ ID NO: 333733 - DNA, 1765 bp, Homo sapiens
ctcccagtgggtgtgcagacactggagagacccagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggcaacttaggaaagtctacagaaaggattcttgagtattaaagcaaagcctggctactctccccttaaaaaaggctagctacatgagaaattgacaacccaaacttctttttggctttagaatgatcactctgaaaaactgtgattaaaaacatcacggaattttgaaaggccttatgaaggcaagtgacaagcacccgcatctgtggcctcatgcgggatttatatgacacgttttcccaaggacaacaggccttacatctgcagtggcaataggcaggtgtcactttgcatttctcagcacaaagcagatttattctttatttggtctgtgggcttagattttagcatgtcaattctagcactcaaaagcaaagacacaggagtgccaatcaaccctgtctctgctagaaacagactcagaggctccgggtgcagctctgcaattcagagtggttctggaggctggagagagaaggtttcaagcagtgcacaaatgcagcacattcgggctacaaataaatggctatctgttgaggctgcatttggaattccagggattgctctaaaccttctggagttgtgcttccgtagcctttgtgtgccctctcggcacatctttgaagaaagagcagtttcatcttcttcagcatctgatgttctgtccgagtcacattccttgtgtgcctgacctctggagaacaatagtgccattgtgcgcagacccggtgtcctggccagtgactcctgctcagcagaaccttcacggcgaatgcttctcctgagcctgcacctgacccctgggccctctgcattcagaggatttcctgtgctttgtagttagcctttgagccagagttagtgctgaagggacctatacgtctgtctgctttttgtttgatttttttgtttgtttattttggccctgggttaagaagatggaaaaaatgattgttaaataaggattaaagtattatgctgatataaaatgta

SEQ ID NO: 333734 - DNA, 489 bp, Homo sapiens
gcactgagccatgattgcatcactgtactccagcctgggcaacagagtgaaaccttgtctcaaaaaagaaaggaaaaaggaaattcacttcaaagacatcaaaataacaactggagatgcccttccatttactaaagtgatctctgaccagtgaacttagactaagttgcaaacccagttctaatggagcagggaggcctaaattcaggccttccttgcattgcacgttgacctggcttgtcacacagggccattttcttgagaaaccagccagtagtgctgagttggtggcaggcatttttgttttctcttgtattgtttacttaaaagtgttaaagaccgttgctgaccttgccagcctaacaaactgaacacagatggactagcccgttaagattcccttgtcttggggctgatgtgagaagttgtctttgctgtggaattaggacctgacatgaaacgcagatctagtggcagagaggaagatga

SEQ ID NO: 333735 - DNA, 1145 bp, Homo sapiens
ccactatactgcccgccactccccccccacccaccaaaacatatacattgttaggcgaggacaacgcaggtgacaaacattaccaccccagctgtgcacgatgcagcagatgcaaccagatgttcacagaaggagaggaaatgtatcttcaaggcaacttaggaaagtctacagaaaggattcttgagtattaaagcaaagcctggctactctccccttaaaaaaggctagctacatgagaaattgacaacccaaacttctttttggctttagaatgatcactctgaaaaactgtgattaaaaacatcacggaattttgaaaggccttatgaaggcaagtgacaagcacccgcatctgtggcctcatgcgggatttatatgacacgttttcccaaggacaacaggccttacatctgcagtggcaataggcaggtgtcactttgcatttctcagcacaaagcagatttattctttatttggtctgtgggcttagattttagcatgtcaattctagcactcaaaagcaaagacacaggagtgccaatcaaccctgtctctgctagaaacagactcagaggctccgggtgcagctctgcaattcagagtggttctggaggctggagagagaaggtttcaagcagtgcacaaatgcagcacattcgggctacaaataaatggctatctgttgaggctgcatttggaattccagggattgctctaaaccttctggagttgtgcttccgtagcctttgtgtgccctctcggcacatctttgaagaaagagcagtttcatcttcttcagcatctgatgttctgtccgagtcacattccttgtgtgcctgacctctggagaacaatagtgccattgtgcgcagacccggtgtcctggccagtgactcctgctcagcagaaccttcacggcgaatgcttctcctgagcctgcacctgacccctgggccctctgcattcagaggatttcctgtgctttgtagttagcctttgagccagagttagtgctgaagggacctatacgtctgtctgctttttgtttgatttttttgtttgtttattttggccctgggttaagaagatggaaaaaatgattgttaaataaggattaaagtattatgctgatataaaatgta

SEQ ID NO: 333736 - DNA, 7273 bp, Homo sapiens
ctcccagtgggtgtgcagacactggagagacccagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333737 - DNA, 7174 bp, Homo sapiens
tattactcctaggctatgaagctgtatagcatgttactggacagaattttgtaggcaattgtaacccaatgtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333738 - DNA, 7368 bp, Homo sapiens
agcaaacattggcaatggatttaaatgctcagattttgaagaaatcaacgactgcaggtgaaatggctttgctaactttaaaatatattattattcaacattgaaacaggaaatcccacatgagcacatgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333739 - DNA, 6789 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333740 - DNA, 7548 bp, Homo sapiens
  misc_feature (2)..(2): n is a, c, g, or t
  misc_feature (4)..(6): n is a, c, g, or t
  misc_feature (10)..(10): n is a, c, g, or t
  misc_feature (12)..(14): n is a, c, g, or t
  misc_feature (16)..(18): n is a, c, g, or t
tngnnnggcngnnngnnnaggtagacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333741 - DNA, 5521 bp, Homo sapiens
tcactacgagcgcatcctgtgactgtcaggactctgggttcctgctctgttctggggtccaaaccttggtctccctttggtcctgctgggagctccccctgcctctttcccctacttagctccttagcaaagagaccctggcctccactttgcccctttgggtacaaagaaggaatagatgattccgtggccttgggggcaggagagagacactctccatgaacacttctccagccacctcatacccccttcccagggtaagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcattttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333742 - DNA, 7458 bp, Homo sapiens
  misc_feature (2)..(2): n is a, c, g, or t
  misc_feature (4)..(6): n is a, c, g, or t
  misc_feature (10)..(10): n is a, c, g, or t
  misc_feature (12)..(14): n is a, c, g, or t
  misc_feature (16)..(18): n is a, c, g, or t
tngnnnggcngnnngnnnaggtagacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagcctccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattatgtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcgtaggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcctcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcatactgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttaaaattattctcttctaaccaatgaagtgtttgtcagtatgccccaaagcttgctcttttgtgctcccttttgaataactttctatccagaaaaagagattatttgggacttgagaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggcgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333743 - DNA, 1427 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgta

SEQ ID NO: 333744 - DNA, 1421 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccgacactcccagatagccacagcctgcgaacctatgagggatcctctaga

SEQ ID NO: 333745 - DNA, 1085 bp, Homo sapiens
aagaaaaattgaggccgggcgcggtggctcacgcctgtaatcccagcactttgggagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgtaagggtgactgttcctggattcactctatataacaaactatgtttctgtgattttttcccctactattgatagcacattgaaaaatcaacgactaaacatttccatccctctcccagagcaaaatgaaaactggtatccaactatattttatgctctatcttttcttgaaacatcagtcatcctaagcctgtgttcattttgatttattaaataattatattttgacagcg

SEQ ID NO: 333746 - DNA, 909 bp, Homo sapiens
ctcccagtgggtgtgcagacactggagagacccagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggttatgctggtacaccttgctgcgttctgtacatgaagaagttgaagctcaaggaagttaaaagaaaaagagaatgga

SEQ ID NO: 333747 - DNA, 368 bp, Homo sapiens
gcttctagcttgcaggctgggccttagtcctgcacataccaaagctgacgggcaggaagggcactctcgacaacccaagagacctaagtacccctcccagggaaatttcttttttctaatcgacatccctcccagcaccacacaccccgcccctgaaaggagatcatcagcccccacaatttgtcagagctgaagccagcccactacccacccccactacagcattgtgcttgggtctgggttctcagtaatgtagccatttgagaaacttacttggggacaaagtctcaatccttattttaaatgaaaaaagaaaagaaaagcataataaatttaaaagaaaaggctgagaaatgaaaaaaatcaaa

SEQ ID NO: 333748 - DNA, 2767 bp, Homo sapiens
tatttttttcagttttagaggattccattttgtgaatgtaccatgttttgttcaagtagtcctatattgatgaatagtctggttattgtcaattttgctattacaaaaaaagtactacagttaacaatgtgcattcatcatcttgtttttggcaagtgtatatttggtaaagattactagaagtacgattgccgctcggaaggtaaaacatatataattttgctagatagtctataaaattattaagtctaatattaatttactttgtttctcccatcagaaagaagccaacaaaacatataactgtgaaaatttaggtctcagtgaaatccctgacactctaccaaacacaacagaatttttggaattcagctttaattttttgcctacaattcacaatagaaccttcagcagactcatgaatcttacctttttggatttaactaggtgccagattaactggatacatgaagacacttttcaaagccatcatcaattaagcacacttgtgttaactggaaatcccctgatattcatggcagaaacatcgcttaatgggcccaagtcactgaagcatcttttcttaatccaaacgggaatatccaatctcgagtttattccagtgcacaatctggaaaacttggaaagcttgtatcttggaagcaaccatatttcctccattaagttccccaaagacttcccagcacggaatctgaaagtactggattttcagaataatgctatacactacatctctagagaagacatgaggtctctggagcaggccatcaacctaagcctgaacttcaatggcaataatgttaaaggtattgagcttggggcttttgattcaacggtcttccaaagtttgaactttggaggaactccaaatttgtctgttatattcaatggtctgcagaactctactactcagtctctctggctgggaacatttgaggacattgatgacgaagatattagttcagccatgctcaagggactctgtgaaatgtctgttgagagcctcaacctgcaggaacaccgcttctctgacatctcatccaccacatttcagtgcttcacccaactccaagaattggatctgacagcaactcacttgaaagggttaccctctgggatgaagggtctgaacttgctcaagaaattagttctcagtgtaaatcatttcgatcaattgtgtcaaatcagtgctgccaatttcccctcccttacacacctctacatcagaggcaacgtgaagaaacttcaccttggtgttggctgcttggagaaactaggaaaccttcagacacttgatttaagccataatgacatagaggcttctgactgctgcagtctgcaactcaaaaacctgtcccacttgcaaaccttaaacctgagccacaatgagcctcttggtctccagagtcaggcattcaaagaatgtcctcagctagaactcctcgatttggcatttacccgcttacacattaatgctccacaaagtcccttccaaaacctccatttccttcaggttctgaatctcacttactgcttccttgataccagcaatcagcatcttctagcaggcctaccagttctccggcatctcaacttaaaagggaatcactttcaagatgggactatcacgaagaccaacctacttcagactgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctgatgtcaagctttcctgtgggattacagccataggcattttctttctcatagtatttctattattgttggctattctgctattttttgcagttaaataccttctcaggtggaaataccaacacatttagtgctgaaggtttccagagaaagcaaataagtgtgcttagcaaaattgctctaagtgaaagaactgtcatctgctggtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagagggagggactgggcagggactgccggccccggagtctcccacagggaggccattccccttctactcaccgacatccctcccagcaccacacaccccgcccctgaaaggagatcatcagcccccacaatttgtcagagctgaagccagcccactacccacccccactacagcattgtgcttgggtctgggttctcagtaatgtagccatttgagaaacttacttggggacaaagtctcaatccttattttaaatgaaaaaagaaaagaaaagcataataaatttaaaagaaaaggctgagaaatgaaaaaaatcaaa

SEQ ID NO: 333749 - DNA, 2720 bp, Homo sapiens
gctgagcagtcaacagcatttcttgttccaagatcacccttctgagtacctctctggctgccaaattgccagggccttcacagtttgattccatttctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaacaaaacatataactgtgaaaatttaggtctcagtgaaatccctgacactctaccaaacacaacagaatttttggaattcagctttaattttttgcctacaattcacaatagaaccttcagcagactcatgaatcttacctttttggatttaactaggtgccagattaactggatacatgaagacacttttcaaagccatcatcaattaagcacacttgtgttaactggaaatcccctgatattcatggcagaaacatcgcttaatgggcccaagtcactgaagcatcttttcttaatccaaacgggaatatccaatctcgagtttattccagtgcacaatctggaaaacttggaaagcttgtatcttggaagcaaccatatttcctccattaagttccccaaagacttcccagcacggaatctgaaagtactggattttcagaataatgctatacactacatctctagagaagacatgaggtctctggagcaggccatcaacctaagcctgaacttcaatggcaataatgttaaaggtattgagcttggggcttttgattcaacggtcttccaaagtttgaactttggaggaactccaaatttgtctgttatattcaatggtctgcagaactctactactcagtctctctggctgggaacatttgaggacattgatgacgaagatattagttcagccatgctcaagggactctgtgaaatgtctgttgagagcctcaacctgcaggaacaccgcttctctgacatctcatccaccacatttcagtgcttcacccaactccaagaattggatctgacagcaactcacttgaaagggttaccctctgggatgaagggtctgaacttgctcaagaaattagttctcagtgtaaatcatttcgatcaattgtgtcaaatcagtgctgccaatttcccctcccttacacacctctacatcagaggcaacgtgaagaaacttcaccttggtgttggctgcttggagaaactaggaaaccttcagacacttgatttaagccataatgacatagaggcttctgactgctgcagtctgcaactcaaaaacctgtcccacttgcaaaccttaaacctgagccacaatgagcctcttggtctccagagtcaggcattcaaagaatgtcctcagctagaactcctcgatttggcatttacccgcttacacattaatgctccacaaagtcccttccaaaacctccatttccttcaggttctgaatctcacttactgcttccttgataccagcaatcagcatcttctagcaggcctaccagttctccggcatctcaacttaaaagggaatcactttcaagatgggactatcacgaagaccaacctacttcagactgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctgatgtcaagctttcctgtgggattacagccataggcattttctttctcatagtatttctattattgttggctattctgctattttttgcagttaaataccttctcaggtggaaataccaacacatttagtgctgaaggtttccagagaaagcaaataagtgtgcttagcaaaattgctctaagtgaaagaactgtcatctgctggtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagagggagggactgggcagggactgccggccccggagtctcccacagggaggccattccccttctactcaccgacatccctcccagcaccacacaccccgcccctgaaaggagatcatcagcccccacaatttgtcagagctgaagccagcccactacccacccccactacagcattgtgcttgggtctgggttctcagtaatgtagccatttgagaaacttacttggggacaaagtctcaatccttattttaaatgaaaaaagaaaagaaaagcataataaatttaaaagaaaaggctgagaaatgaaaaaaatcaaa

SEQ ID NO: 333750 - DNA, 1668 bp, Homo sapiens
aaaaaaaaaaccccccccattgtgggggttttttgtgggtttttccccctttttttccccccggggccgggggtttaacggcacactttaaatggaagagaggttgtggctataacttgtggctgggaataataaagatggcaccgccaaggagcctcaccttgcgtgagtgagtactcagttgggcgctgcagggtctggagtctgtgtgagacgtgtgtgattgtgatgggtgcgaatcagcgtatagcacttgagaacaaggcagaccttggagcagaatggttatgtgaaggatcacatcacccatgggtagggggggaagtcatacgtcctggaggtgctggtcctcctcctggaactgccagccttgctaggactatcaacatcaacagcattgcctggtaaaccctactgtttgtgctccccactgtgtcccatgactggtgttaaaattctccctactttgatcatctgccctgcccaggccttgggctttatgccagcacagagctcaaaggccaggtagcagcacatcctcaagcatgagagctcaaagggttacatttgagtctctgtacctgcttggaagaaataaaaatacgtgtgaattccatctcatccatgaatagttacaaattcttgactagcattctgtccagttctttgccatttttacgtcttttttacaagggagattaaaatagctcctgactcagttacagctccctgcagtgttcagcactttaggggtgggagagacattctggagtccttcagtatatatatgtgtcagttaaactatggtgccgtgtttctatttcagggtttatccatgtgtattcccattgattcatgtctgattgaacctggcattgtatgtttacttttcttgatttttgctgtctgttggcagacctctttatttttcagccaaaacccaagagaggaaatatttgcgttacctaaaactatagcagaatcatccttatgggttgtgaaaaaggacgttggcctgtatgagttctaactcctagaatgagaaccaacccccgtcaggagctcacctcttcgggtgctggaggtcaacagtgaatgccccagttacccccacccctgtgacttagaaatgtaggaaataaagtgccctctgagatgcagctaatccagtcccagtaggaggcgctgaaaggactcaagtctggagtctgaagggccgtctggccaggatcaggtgcatagcttaacttttattcattcaacaaagatttaaggcttgctacttccaaggcactgttctaggtattaggggtgcagcagtaaacacaataggtgaatcagatgttaatacatctggccaggcacggtggttcacgcctgtaattccagcactttgggaggccgaggcgagtggatcacctgaggtcaggagttggagaccagcctggccaacatggtgaaaccccgtctctactaaaaatagaaaaattagctgggtgtggtggcacgtgcctgtaatcccagctactggggaggctgaggtaggagaattgcttgaaccaaggagacagaggttgcagtgagccgagatcacaccattgcactccagcctgggagacagagcgagactccatctcagaaaaaaaaaaaaaaaaaaaaaaaaagatg

SEQ ID NO: 333751 - DNA, 7692 bp, Homo sapiens
acgtgggacactctacggtggccgagaggatgccgcagatgtgttagcggcgagtccagaagcagccccaggaggtgctgggggcatcgtttctctaatctggcctcccgagtgccaaggaggcgtcccggcagcggtcatcatggtgaaggagcagttccgggagacggatgtggccaagaaaataagccacatctgttttggaatgaagtcacctgaggagatgcgccagcaggcgcacatccaagttgtgagtaagaacctgtacagccaggacaaccaacatgcccccttgctatatggggtgctcgaccataggatgggtacgagtgagaaggatcgtccatgtgaaacctgtgggaaaaacttggctgactgtctaggccactatgggtatatcgacctggagttgccgtgttttcatgtagggtacttcagagcagtcataggcatcttacagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtaccgtaaagaagtgtggactgctgaaaataattcatgagaaatacaagaccaacaaaaaagtggtggatcccattgtatcaaatttccttcagtcttttgaaacagccattgaacataataaagaagtggagcctctgctgggaagggcacaggaaaacttgaatcccttagtagttctgaatttatttaaacgaatcccagctgaagatgttcctctacttctgatgaacccagaagccggaaagccgtctgatttgattctcacacgacttttggtgcctcctttgtgtatcagaccctccgttgtgagtgatttgaagtctggcaccaatgaagatgatctgacaatgaaactgacagaaatcattttcctaaacgatgttattaaaaagcatcggatctcaggagccaagacccagatgatcatggaggactgggatttcctgcagctgcagtgtgccctctacattaacagtgagctctcgggcattcccctcaacatggcacccaagaagtggaccagaggcttcgtccaacgcctgaagggaaaacagggtcgatttagaggaaatctctcaggaaagagagtggatttttctggcagaacagtcatctcgcccgaccccaacctccggattgatgaggtagctgtgccagttcatgtggccaaaattctaacttttcctgagaaggtaaacaaagcaaacatcaatttcttgaggaaactggttcaaaacggccctgaggttcacccaggagcaaacttcattcagcagagacatacgcagatgaaaaggtttttgaaatacggaaatcgagaaaagatggctcaagagctcaagtatggtgacatcgtagagagacacctcatcgatggagatgtggtgctgttcaatcggcagccctcgctgcacaaattgagcattatggctcatctggccagggtcaagccccaccggaccttcagatttaatgagtgtgtctgtacaccctataatgctgactttgatggtgatgaaatgaaccttcatcttcctcaaacagaagaagctaaagcagaggcccttgttctgatggggactaaagcaaatcttgtaaccccgaggaatggggaaccgctgattgctgctattcaggattttctaacaggtgcctatctcctcactctcaaggacactttctttgatcgagccaaggcttgccaaatcattgcttcaatactggttggcaaggatgagaaaattaaagttcgcctcccaccgcctacaatcctaaagcctgtcaccctgtggacgggaaagcagatcttcagtgtcatcctcaggcctagcgatgacaatccagtgagggccaacctgcgaaccaagggcaagcagtactgtggcaaaggggaagatctctgtgccaatgattcctatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtctaaccgtggtttctcaattgggatcggtgatgtcacacctggccaaggactgctgaaggccaagtatgagttgctgaatgccggctacaagaaatgtgatgagtacatcgaagccctgaacacgggcaagctgcagcagcagcctggctgcactgctgaggagaccctggaggcactgatcctgaaggagctgtctgtgatccgtgaccacgctggcagtgcctgcctccgggagctggacaagagcaacagccccctcaccatggctctgtgcggctccaaaggttccttcattaacatatcacagatgattgcctgtgtgggacagcaggccatcagtggctctcgagtgccagacggctttgaaaacaggtccttgcctcattttgaaaaacactcaaagctcccagctgccaaaggctttgtggctaatagcttttattccggtttgacaccaactgagtttttcttccacacaatggccggccgggaaggtctagtcgacacggctgtaaagacagctgaaacgggatacatgcagcgaaggcttgtcaaatctcttgaagatctttgctcccagtatgatctgacagtccgaagctctactggcgatattatccagttcatttatggaggagatggcttagatcctgcagctatggagggaaaagatgaacctttggagtttaaaagggttctggacaacatcaaagcagtcttcccgtgtcccagtgagcctgctctcagcaaaaacgagctgatcctgaccacagagtccatcatgaagaagagtgagttcctctgctgccaggacagcttcctgcaggaaataaaaaaattcattaagggggtctctgagaagatcaagaaaaccagagataaatatggcatcaatgataacggcacaacagagccccgtgtgctgtaccagctggaccgcatcacccccacccaagtagaaaagtttctggagacctgtagggacaagtacatgagggcacagatggagccaggttctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcagcactccaattatcacagcacagctagacaaggatgacgacgcggattatgctcgcctcgtgaaagggagaattgagaaaaccctcttgggagagatttccgagtatattgaagaagtgtttcttcctgatgactgctttattctcgtcaagctctccctggaacggattaggcttctgagactggaagtgaacgctgagacagtgagatattccatctgcacatccaagctccgtgtgaagcccggtgatgtggctgttcatggtgaggctgtggtgtgtgtcacccccagagagaacagcaagagctccatgtactacgtgctgcagttcctgaaagaggatctccccaaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaaccacctccaataacacctatgaggtggagaaaactctgggcatcgaggccgcccggacaacgatcatcaatgaaatccagtacaccatggtgaaccacggcatgagcatcgacaggaggcacgtgatgctgctctccgacctcatgacctacaagggtgaagtcctgggcatcactaggtttggcctggccaagatgaaggagagtgtgctgatgctggcctcctttgagaagacggctgaccatctctttgacgctgcctacttcgggcagaaggactctgtgtgtggggtgtctgagtgcatcatcatgggaatcccaatgaacattggaaccgggctcttcaagctgcttcacaaggctgacagggacccgaaccctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcgggagagctgagggttttattgtttgcttgcttgaaacctaatctatagacggccccacagctcgtgcacacactgcttccctggacttaaagcccagccaggtgtcatggtccatcccagctcactgcatacatccatcggctccccatggtgtcttcacacctgacgatgagccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggcccaggcagctctgtaacatcttctatagatgcccctggctaccctgttgttttcatctacctcagacccctatcatggggctctaccctgtgacaagagccaaacccattctccatggcctatggaagcctcactggagtttggggcctgctgcaatggggatgagatggttttttgtagaattatacttacgttccttggatgatctctagttgattttttaagttctgagttgatgctgttaaggtacccggggtagccattggttcttggatctgtgttagaatgagtgctttcccttcctactgatgtgattgtggattaggaattcgtgaccgagtgatttttggccagtggttgggtttaaaattctattaaaatttgtagtttgggctgggtgctgtggctcatacctataatcccagcactttgggaggccgaggggggcagatcacttgagcccaggagttcgagagcagcctgggcaacatgacgaaaccccgtctctacagagaatacaaaaattagccaggcatggtggcccatgcctgtagtacctgctattggtaaggctgaggtggaaggttcacttgagcctgggaggtggaggttgtagtgagccaagatcgtgccactacactccagcctgggcaacaaagcaagaccttgtctcaaaaaaaaaaaaagaaaaaaattaagcgtaaaaaaaaattagtttttataaaaaattatagtttgaccttttgatttccctgcatctacaaggtagacctattaacttctcttggggtatcagtgatgtggaaaaaaaatgccatttttcttaatgtttaacccccctttatctttgaattgagctagagcctggtttaggacaaaggattaagtttgttaatgaacactaattcagggcttctacttgagaccccaccgagatcaccagttctcatgtaacctgggaagagccataaaggggtaccccccaccccaactgccttcctggaagcatgcctgggaagtaagctgtaggcctgatccgagccaggaccactgggatccgtgcaaaggccaggggagggtagaattgaatcataggagtgaactccggcacctgttgtcttctgcgggtgacgcacactttaaatggaagagaggttgtggctataacttgtggctgggaataataaagatggcaccgccaaggagcctcaccttgcgtgagtgagtactcagttgggcgctgcagggtctggagtctgtgtgagacgtgtgtgattgtgatgggtgcgaatcagcgtatagcacttgagaacaaggcagaccttggagcagaatggttatgtgaaggatcacatcacccatgggtagggggggaagtcatacgtcctggaggtgctggtcctcctcctggaactgccagccttgctaggactatcaacatcaacagcattgcctggtaaaccctactgtttgtgctccccactgtgtcccatgactggtgttaaaattctccctactttgatcatctgccctgcccaggccttgggctttatgccagcacagagctcaaaggccaggtagcagcacatcctcaagcatgagagctcaaagggttacatttgagtctctgtacctgcttggaagaaataaaaatacgtgtgaattccatctcatccatgaatagttacaaattcttgactagcattctgtccagttctttgccatttttacgtcttttttacaagggagattaaaatagctcctgactcagttacagctccctgcagtgttcagcactttaggggtgggagagacattctggagtccttcagtatatatatgtgtcagttaaactatggtgccgtgtttctatttcagggtttatccatgtgtattcccattgattcatgtctgattgaacctggcattgtatgtttacttttcttgatttttgctgtctgttggcagacctctttatttttcagccaaaacccaagagaggaaatatttgcgttacctaaaactatagcagaatcatccttatgggttgtgaaaaaggacgttggcctgtatgagttctaactcctagaatgagaaccaacccccgtcaggagctcacctcttcgggtgctggaggtcaacagtgaatgccccagttacccccacccctgtgacttagaaatgtaggaaataaagtgccctctgagatgcagctaatccagtcccagtaggaggcgctgaaaggactcaagtctggagtctgaagggccgtctggccaggatcaggtgcatagcttaacttttattcattcaacaaagatttaaggcttgctacttccaaggcactgttctaggtattaggggtgcagcagtaaacacaataggtgaatcagatgttaatacatctggccaggcacggtggttcacgcctgtaattccagcactttgggaggccgaggcgagtggatcacctgaggtcaggagttggagaccagcctggccaacatggtgaaaccccgtctctactaaaaatagaaaaattagctgggtgtggtggcacgtgcctgtaatcccagctactggggaggctgaggtaggagaattgcttgaaccaaggagacagaggttgcagtgagccgagatcacaccattgcactccagcctgggagacagagcgagactccatctcagaaaaaaaaaaaaaaaaaaaaaaaaagatg

SEQ ID NO: 333752 - DNA, 6271 bp, Homo sapiens
acgtgggacactctacggtggccgagaggatgccgcagatgtgttagcggcgagtccagaagcagccccaggaggtgctgggggcatcgtttctctaatctggcctcccgagtgccaaggaggcgtcccggcagcggtcatcatggtgaaggagcagttccgggagacggatgtggccaagaaaataagccacatctgttttggaatgaagtcacctgaggagatgcgccagcaggcgcacatccaagttgtgagtaagaacctgtacagccaggacaaccaacatgcccccttgctatatggggtgctcgaccataggatgggtacgagtgagaaggatcgtccatgtgaaacctgtgggaaaaacttggctgactgtctaggccactatgggtatatcgacctggagttgccgtgttttcatgtagggtacttcagagcagtcataggcatcttacagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtaccgtaaagaagtgtggactgctgaaaataattcatgagaaatacaagaccaacaaaaaagtggtggatcccattgtatcaaatttccttcagtcttttgaaacagccattgaacataataaagaagtggagcctctgctgggaagggcacaggaaaacttgaatcccttagtagttctgaatttatttaaacgaatcccagctgaagatgttcctctacttctgatgaacccagaagccggaaagccgtctgatttgattctcacacgacttttggtgcctcctttgtgtatcagaccctccgttgtgagtgatttgaagtctggcaccaatgaagatgatctgacaatgaaactgacagaaatcattttcctaaacgatgttattaaaaagcatcggatctcaggagccaagacccagatgatcatggaggactgggatttcctgcagctgcagtgtgccctctacattaacagtgagctctcgggcattcccctcaacatggcacccaagaagtggaccagaggcttcgtccaacgcctgaagggaaaacagggtcgatttagaggaaatctctcaggaaagagagtggatttttctggcagaacagtcatctcgcccgaccccaacctccggattgatgaggtagctgtgccagttcatgtggccaaaattctaacttttcctgagaaggtaaacaaagcaaacatcaatttcttgaggaaactggttcaaaacggccctgaggttcacccaggagcaaacttcattcagcagagacatacgcagatgaaaaggtttttgaaatacggaaatcgagaaaagatggctcaagagctcaagtatggtgacatcgtagagagacacctcatcgatggagatgtggtgctgttcaatcggcagccctcgctgcacaaattgagcattatggctcatctggccagggtcaagccccaccggaccttcagatttaatgagtgtgtctgtacaccctataatgctgactttgatggtgatgaaatgaaccttcatcttcctcaaacagaagaagctaaagcagaggcccttgttctgatggggactaaagcaaatcttgtaaccccgaggaatggggaaccgctgattgctgctattcaggattttctaacaggtgcctatctcctcactctcaaggacactttctttgatcgagccaaggcttgccaaatcattgcttcaatactggttggcaaggatgagaaaattaaagttcgcctcccaccgcctacaatcctaaagcctgtcaccctgtggacgggaaagcagatcttcagtgtcatcctcaggcctagcgatgacaatccagtgagggccaacctgcgaaccaagggcaagcagtactgtggcaaaggggaagatctctgtgccaatgattcctatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtctaaccgtggtttctcaattgggatcggtgatgtcacacctggccaaggactgctgaaggccaagtatgagttgctgaatgccggctacaagaaatgtgatgagtacatcgaagccctgaacacgggcaagctgcagcagcagcctggctgcactgctgaggagaccctggagcgaaggcttgtcaaatctcttgaagatctttgctcccagtatgatctgacagtccgaagctctactggcgatattatccagttcatttatggaggagatggcttagatcctgcagctatggagggaaaagatgaacctttggagtttaaaagggttctggacaacatcaaagcagtcttcccgtgtcccagtgagcctgctctcagcaaaaacgagctgatcctgaccacagagtccatcatgaagaagagtgagttcctctgctgccaggacagcttcctgcaggaaataaaaaaattcattaagggggtctctgagaagatcaagaaaaccagagataaatatggcatcaatgataacggcacaacagagccccgtgtgctgtaccagctggaccgcatcacccccacccaagtagaaaagtttctggagacctgtagggacaagtacatgagggcacagatggagccaggttctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcagcactccaattatcacagcacagctagacaaggatgacgacgcggattatgctcgcctcgtgaaagggagaattgagaaaaccctcttgggagagatttccgagtatattgaagaagtgtttcttcctgatgactgctttattctcgtcaagctctccctggaacggattaggcttctgagactggaagtgaacgctgagacagtgagatattccatctgcacatccaagctccgtgtgaagcccggtgatgtggctgttcatggtgaggctgtggtgtgtgtcacccccagagagaacagcaagagctccatgtactacgtgctgcagttcctgaaagaggatctccccaaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaaccacctccaataacacctatgaggtggagaaaactctgggcatcgaggccgcccggacaacgatcatcaatgaaatccagtacaccatggtgaaccacggcatgagcatcgacaggaggcacgtgatgctgctctccgacctcatgacctacaagggtgaagtcctgggcatcactaggtttggcctggccaagatgaaggagagtgtgctgatgctggcctcctttgagaagacggctgaccatctctttgacgctgcctacttcgggcagaaggactctgtgtgtggggtgtctgagtgcatcatcatgggaatcccaatgaacattggaaccgggctcttcaagctgcttcacaaggctgacagggacccgaaccctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcgggagagctgagggttttattgtttgcttgcttgaaacctaatctatagacggccccacagctcgtgcacacactgcttccctggacttaaagcccagccaggtgtcatggtccatcccagctcactgcatacatccatcggctccccatggtgtcttcacacctgacgatgagccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggcccaggcagctctgtaacatcttctatagatgcccctggctaccctgttgttttcatctacctcagacccctatcatggggctctaccctgtgacaagagccaaacccattctccatggcctatggaagcctcactggagtttggggcctgctgcaatggggatgagatggttttttgtagaattatacttacgttccttggatgatctctagttgattttttaagttctgagttgatgctgttaaggtacccggggtagccattggttcttggatctgtgttagaatgagtgctttcccttcctactgatgtgattgtggattaggaattcgtgaccgagtgatttttggccagtggttgggtttaaaattctattaaaatttgtagtttgggctgggtgctgtggctcatacctataatcccagcactttgggaggccgaggggggcagatcacttgagcccaggagttcgagagcagcctgggcaacatgacgaaaccccgtctctacagagaatacaaaaattagccaggcatggtggcccatgcctgtagtacctgctattggtaaggctgaggtggaaggttcacttgagcctgggaggtggaggttgtagtgagccaagatcgtgccactacactccagcctgggcaacaaagcaagaccttgtctcaaaaaaaaaaaaagaaaaaaattaagcgtaaaaaaaaattagtttttataaaaaattatagtttgaccttttgatttccctgcatctacaaggtagacctattaacttctcttggggtatcagtgatgtggaaaaaaaatgccatttttcttaatgtttaacccccctttatctttgaattgagctagagcctggtttaggacaaaggattaagtttgttaatgaacactaattcagggcttctacttgagaccccaccgagatcaccagttctcatgtaacctgggaagagccataaaggggtaccccccaccccaactgccttcctggaagcatgcctgggaagtaagctgtaggcctgatccgagccaggaccactgggatccgtgcaaaggccaggggagggtagaattgaatcataggagtgaactccggcacctgttgtcttctgcgggtgacgcacactttaaatggaagagaggttgtggctataacttgtggctgggaataataaagatggcaccgccaaggagcctcaccttgcgtgagtgagtactcagttgggcgctgcagggtctggagtctgtgtgagacgtgtgtgattgtgatgggtgcgaatcagcgtatagcacttgagaacaaggcagaccttggagcagaatggttatgtgaaggatcacatcacccatgggtagggggggaagtcatacgtcctggaggtgctggtcctcctcctggaactgccagccttgctaggactatcaacatcaacagcattgcctggtaaaccctactgtttgtgctccccactgtgtcccatgactggtgttaaaattctccctactttgatcatctgccctgcccaggccttgggctttatgccagcacagagctcaaaggccaggtagcagcacatcctcaagcatgagagctcaaagggttacatttgagtctctgtacctgcttggaagaaataaaaatacgtgtgaattcca

SEQ ID NO: 333753 - DNA, 6570 bp, Homo sapiens
acgtgggacactctacggtggccgagaggatgccgcagatgtgttagcggcgagtccagaagcagccccaggaggtgctgggggcatcgtttctctaatctggcctcccgagtgccaaggaggcgtcccggcagcggtcatcatggtgaaggagcagttccgggagacggatgtggccaagaaaataagccacatctgttttggaatgaagtcacctgaggagatgcgccagcaggcgcacatccaagttgtgagtaagaacctgtacagccaggacaaccaacatgcccccttgctatatggggtgctcgaccataggatgggtacgagtgagaaggatcgtccatgtgaaacctgtgggaaaaacttggctgactgtctaggccactatgggtatatcgacctggagttgccgtgttttcatgtagggtacttcagagcagtcataggcatcttacagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtaccgtaaagaagtgtggactgctgaaaataattcatgagaaatacaagaccaacaaaaaagtggtggatcccattgtatcaaatttccttcagtcttttgaaacagccattgaacataataaagaagtggagcctctgctgggaagggcacaggaaaacttgaatcccttagtagttctgaatttatttaaacgaatcccagctgaagatgttcctctacttctgatgaacccagaagccggaaagccgtctgatttgattctcacacgacttttggtgcctcctttgtgtatcagaccctccgttgtgagtgatttgaagtctggcaccaatgaagatgatctgacaatgaaactgacagaaatcattttcctaaacgatgttattaaaaagcatcggatctcaggagccaagacccagatgatcatggaggactgggatttcctgcagctgcagtgtgccctctacattaacagtgagctctcgggcattcccctcaacatggcacccaagaagtggaccagaggcttcgtccaacgcctgaagggaaaacagggtcgatttagaggaaatctctcaggaaagagagtggatttttctggcagaacagtcatctcgcccgaccccaacctccggattgatgaggtagctgtgccagttcatgtggccaaaattctaacttttcctgagaaggtaaacaaagcaaacatcaatttcttgaggaaactggttcaaaacggccctgaggttcacccaggagcaaacttcattcagcagagacatacgcagatgaaaaggtttttgaaatacggaaatcgagaaaagatggctcaagagctcaagtatggtgacatcgtagagagacacctcatcgatggagatgtggtgctgttcaatcggcagccctcgctgcacaaattgagcattatggctcatctggccagggtcaagccccaccggaccttcagatttaatgagtgtgtctgtacaccctataatgctgactttgatggtgatgaaatgaaccttcatcttcctcaaacagaagaagctaaagcagaggcccttgttctgatggggactaaagcaaatcttgtaaccccgaggaatggggaaccgctgattgctgctattcaggattttctaacaggtgcctatctcctcactctcaaggacactttctttgatcgagccaaggcttgccaaatcattgcttcaatactggttggcaaggatgagaaaattaaagttcgcctcccaccgcctacaatcctaaagcctgtcaccctgtggacgggaaagcagatcttcagtgtcatcctcaggcctagcgatgacaatccagtgagggccaacctgcgaaccaagggcaagcagtactgtggcaaaggggaagatctctgtgccaatgattcctatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtctaaccgtggtttctcaattgggatcggtgatgtcacacctggccaaggactgctgaaggccaagtatgagttgctgaatgccggctacaagaaatgtgatgagtacatcgaagccctgaacacgggcaagctgcagcagcagcctggctgcactgctgaggagaccctggaggcactgatcctgaaggagctgtctgtgatccgtgaccacgctggcagtgcctgcctccgggagctggacaagagcaacagccccctcaccatggctctgtgcggctccaaaggttccttcattaacatatcacagatgattgcctgtgtgggacagcaggccatcagtggctctcgagtgccagacggctttgaaaacaggtccttgcctcattttgaaaaacactcaaagctcccagctgccaaaggctttgtggctaatagcttttattccggtttgacaccaactgagtttttcttccacacaatggccggccgggaaggtctagtcgacacggctgtaaagacagctgaaacgggatacatgcagcgaaggcttgtcaaatctcttgaagatctttgctcccagtatgatctgacagtccgaagctctactggcgatattatccagttcatttatggaggagatggcttagatcctgcagctatggagggaaaagatgaacctttggagtttaaaagggttctggacaacatcaaagcagtcttcccgtgtcccagtgagcctgctctcagcaaaaacgagctgatcctgaccacagagtccatcatgaagaagagtgagttcctctgctgccaggacagcttcctgcaggaaataaaaaaattcattaagggggtctctgagaagatcaagaaaaccagagataaatatggcatcaatgataacggcacaacagagccccgtgtgctgtaccagctggaccgcatcacccccacccaagtagaaaagtttctggagacctgtagggacaagtacatgagggcacagatggagccaggttctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcagcactccaattatcacagcacagctagacaaggatgacgacgcggattatgctcgcctgatgactgctttattctcgtcaagctctccctggaacggattaggcttctgagactggaagtgaacgctgagacagtgagatattccatctgcacatccaagctccgtgtgaagcccggtgatgtggctgttcatggtgaggctgtggtgtgtgtcacccccagagagaacagcaagagctccatgtactacgtgctgcagttcctgaaagaggatctccccaaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaaccacctccaataacacctatgaggtggagaaaactctgggcatcgaggccgcccggacaacgatcatcaatgaaatccagtacaccatggtgaaccacggcatgagcatcgacaggaggcacgtgatgctgctctccgacctcatgacctacaagggtgaagtcctgggcatcactaggtttggcctggccaagatgaaggagagtgtgctgatgctggcctcctttgagaagacggctgaccatctctttgacgctgcctacttcgggcagaaggactctgtgtgtggggtgtctgagtgcatcatcatgggaatcccaatgaacattggaaccgggctcttcaagctgcttcacaaggctgacagggacccgaaccctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcgggagagctgagggttttattgtttgcttgcttgaaacctaatctatagacggccccacagctcgtgcacacactgcttccctggacttaaagcccagccaggtgtcatggtccatcccagctcactgcatacatccatcggctccccatggtgtcttcacacctgacgatgagccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggcccaggcagctctgtaacatcttctatagatgcccctggctaccctgttgttttcatctacctcagacccctatcatggggctctaccctgtgacaagagccaaacccattctccatggcctatggaagcctcactggagtttggggcctgctgcaatggggatgagatggttttttgtagaattatacttacgttccttggatgatctctagttgattttttaagttctgagttgatgctgttaaggtacccggggtagccattggttcttggatctgtgttagaatgagtgctttcccttcctactgatgtgattgtggattaggaattcgtgaccgagtgatttttggccagtggttgggtttaaaattctattaaaatttgtagtttgggctgggtgctgtggctcatacctataatcccagcactttgggaggccgaggggggcagatcacttgagcccaggagttcgagagcagcctgggcaacatgacgaaaccccgtctctacagagaatacaaaaattagccaggcatggtggcccatgcctgtagtacctgctattggtaaggctgaggtggaaggttcacttgagcctgggaggtggaggttgtagtgagccaagatcgtgccactacactccagcctgggcaacaaagcaagaccttgtctcaaaaaaaaaaaaagaaaaaaattaagcgtaaaaaaaaattagtttttataaaaaattatagtttgaccttttgatttccctgcatctacaaggtagacctattaacttctcttggggtatcagtgatgtggaaaaaaaatgccatttttcttaatgtttaacccccctttatctttgaattgagctagagcctggtttaggacaaaggattaagtttgttaatgaacactaattcagggcttctacttgagaccccaccgagatcaccagttctcatgtaacctgggaagagccataaaggggtaccccccaccccaactgccttcctggaagcatgcctgggaagtaagctgtaggcctgatccgagccaggaccactgggatccgtgcaaaggccaggggagggtagaattgaatcataggagtgaactccggcacctgttgtcttctgcgggtgacgcacactttaaatggaagagaggttgtggctataacttgtggctgggaataataaagatggcaccgccaaggagcctcaccttgcgtgagtgagtactcagttgggcgctgcagggtctggagtctgtgtgagacgtgtgtgattgtgatgggtgcgaatcagcgtatagcacttgagaacaaggcagaccttggagcagaatggttatgtgaaggatcacatcacccatgggtagggggggaagtcatacgtcctggaggtgctggtcctcctcctggaactgccagccttgctaggactatcaacatcaacagcattgcctggtaaaccctactgtttgtgctccccactgtgtcccatgactggtgttaaaattctccctactttgatcatctgccctgcccaggccttgggctttatgccagcacagagctcaaaggccaggtagcagcacatcctcaagcatgagagctcaaagggttacatttgagtctctgtacctgcttggaagaaataaaaatacgtgtgaattcca

SEQ ID NO: 333754 - DNA, 3249 bp, Homo sapiens
acgtgggacactctacggtggccgagaggatgccgcagatgtgttagcggcgagtccagaagcagccccaggaggtgctgggggcatcgtttctctaatctggcctcccgagtgccaaggaggcgtcccggcagcggtcatcatggtgaaggagcagttccgggagacggatgtggccaagaaaataagccacatctgttttggaatgaagtcacctgaggagatgcgccagcaggcgcacatccaagttgtgagtaagaacctgtacagccaggacaaccaacatgcccccttgctatatggggtgctcgaccataggatgggtacgagtgagaaggatcgtccatgtgaaacctgtgggaaaaacttggctgactgtctaggccactatgggtatatcgacctggagttgccgtgttttcatgtagggtacttcagagcagtcataggcatcttacagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtaccgtaaagaagtgtggactgctgaaaataattcatgagaaatacaagaccaacaaaaaagtggtggatcccattgtatcaaatttccttcagtcttttgaaacagccattgaacataataaagaagtggagcctctgctgggaagggcacaggaaaacttgaatcccttagtagttctgaatttatttaaacgaatcccagctgaagatgttcctctacttctgatgaacccagaagccggaaagccgtctgatttgattctcacacgacttttggtgcctcctttgtgtatcagaccctccgttgtgagtgatttgaagtctggcaccaatgaagatgatctgacaatgaaactgacagaaatcattttcctaaacgatgttattaaaaagcatcggatctcaggagccaagacccagatgatcatggaggactgggatttcctgcagctgcagtgtgccctctacattaacagtgagctctcgggcattcccctcaacatggcacccaagaagtggaccagaggcttcgtccaacgcctgaagggaaaacagggtcgatttagaggaaatctctcaggaaagagagtggatttttctggcagaacagtcatctcgcccgaccccaacctccggattgatgaggtagctgtgccagttcatgtggccaaaattctaacttttcctgagaaggtaaacaaagcaaacatcaatttcttgaggaaactggttcaaaacggccctgaggttcacccaggagcaaacttcattcagcagagacatacgcagatgaaaaggtttttgaaatacggaaatcgagaaaagatggctcaagagctcaagtatggtgacatcgtagagagacacctcatcgatggagatgtggtgctgttcaatcggcagccctcgctgcacaaattgagcattatggctcatctggccagggtcaagccccaccggaccttcagatttaatgagtgtgtctgtacaccctataatgctgactttgatggtgatgaaatgaaccttcatcttcctcaaacagaagaagctaaagcagaggcccttgttctgatggggactaaagcaaatcttgtaaccccgaggaatggggaaccgctgattgctgctattcaggattttctaacaggtgcctatctcctcactctcaaggacactttctttgatcgagccaaggcttgccaaatcattgcttcaatactggttggcaaggatgagaaaattaaagttcgcctcccaccgcctacaatcctaaagcctgtcaccctgtggacgggaaagcagatcttcagtgtcatcctcaggcctagcgatgacaatccagtgagggccaacctgcgaaccaagggcaagcagtactgtggcaaaggggaagatctctgtgccaatgattcctatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtctaaccgtggtttctcaattgggatcggtgatgtcacacctggccaaggactgctgaaggccaagtatgagttgctgaatgccggctacaagaaatgtgatgagtacatcgaagccctgaacacgggcaagctgcagcagcagcctggctgcactgctgaggagaccctggaggcactgatcctgaaggagctgtctgtgatccgtgaccacgctggcagtgcctgcctccgggagctggacaagagcaacagccccctcaccatggctctgtgcggctccaaaggttccttcattaacatatcacagatgattgcctgtgtgggacagcaggccatcagtggctctcgagtgccagacggctttgaaaacaggtccttgcctcattttgaaaaacactcaaagctcccagctgccaaaggctttgtggctaatagcttttattccggtttgacaccaactgagtttttcttccacacaatggccggccgggaaggtctagtcgacacggctgtaaagacagctgaaacgggatacatgcagcgaaggcttgtcaaatctcttgaagatctttgctcccagtatgatctgacagtccgaagctctactggcgatattatccagttcatttatggaggagatggcttagatcctgcagctatggagggaaaagatgaacctttggagtttaaaagggttctggacaacatcaaagcagtcttcccgtgtcccagtgagcctgctctcagcaaaaacgagctgatcctgaccacagagtccatcatgaagaagagtgagttcctctgctgccaggacagcttcctgcagagctcggaggtggaactcgtgactgtgtatgggcacatgtgagtgcgtgtgtgtggacagccaggcttagtgtagacaacgtgtgaggctcagaccccaagtgctgactacacctatgcacatccacacctgcgtgtgaaagaagatgctagaaaagaacaaaaataacttaaaaaataaatccaataagatggctggaacataaa

SEQ ID NO: 333755 - DNA, 261 bp, Homo sapiens
aaaactagctctagtgtgttaacagatgaccactgctgaaagctggggtgatcaaggtgatcagcccagggcatggctcaccccgtcctcacagctttctctgtctctgaatccaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaacca

SEQ ID NO: 333756 - DNA, 577 bp, Homo sapiens
gcatcaatgataacggcacaacagaggtaatatccctccaagacgcgttagaaccccgagctgtttgtagttgccgctggccctaactctgtgcttggcttgtattctcccagccccgtgtgctgtaccagctggaccgcatcacccccacccaagtagaaaagtttctggagacctgtagggacaagtacatgaggtagggatgcttttgtcttggactgacggtcatccacataggtctcacgtatcccttctgtttccccatgtgtacaaaaccctgcaccagctcacttgttaactgccagtatttgatcagattctgtcacattttctgtagggggtctgatgaattgccagtctgaatgctccaagataacggaaataattgcaaggaaatttcttagtgtcttctccccatggggaaactgctaacgaatatggcagatgccactgctctgtttgccatcagtaccattggttagcagactgcttagattttctgcatccattacatgctgaccacaagcagccatgcagaattgagttgcactgctgccccctctctgacctttacttt

SEQ ID NO: 333757 - DNA, 598 bp, Homo sapiens
ctctctgatgttcattctggttggtttcaggggtgtctgagtgcatcatcatgggaatcccaatgaacattggaaccgggctcttcaagctgcttcacaaggctgacagggacccgaaccctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcgggagagctgagggttttattgtttgcttgcttgaaacctaatctatagacggccccacagctcgtgcacacactgcttccctggacttaaagcccagccaggtgtcatggtccatcccagctcactgcatacatccatcggctccccatggtgtcttcacacctgacgatgagccaggcctgagccccacacaggccagggcacattcttg

SEQ ID NO: 333758 - DNA, 6640 bp, Homo sapiens
acgtgggacactctacggtggccgagaggatgccgcagatgtgttagcggcgagtccagaagcagccccaggaggtgctgggggcatcgtttctctaatctggcctcccgagtgccaaggaggcgtcccggcagcggtcatcatggtgaaggagcagttccgggagacggatgtggccaagaaaataagccacatctgttttggaatgaagtcacctgaggagatgcgccagcaggcgcacatccaagttgtgagtaagaacctgtacagccaggacaaccaacatgcccccttgctatatggggtgctcgaccataggatgggtacgagtgagaaggatcgtccatgtgaaacctgtgggaaaaacttggctgactgtctaggccactatgggtatatcgacctggagttgccgtgttttcatgtagggtacttcagagcagtcataggcatcttacagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtaccgtaaagaagtgtggactgctgaaaataattcatgagaaatacaagaccaacaaaaaagtggtggatcccattgtatcaaatttccttcagtcttttgaaacagccattgaacataataaagaagtggagcctctgctgggaagggcacaggaaaacttgaatcccttagtagttctgaatttatttaaacgaatcccagctgaagatgttcctctacttctgatgaacccagaagccggaaagccgtctgatttgattctcacacgacttttggtgcctcctttgtgtatcagaccctccgttgtgagtgatttgaagtctggcaccaatgaagatgatctgacaatgaaactgacagaaatcattttcctaaacgatgttattaaaaagcatcggatctcaggagccaagacccagatgatcatggaggactgggatttcctgcagctgcagtgtgccctctacattaacagtgagctctcgggcattcccctcaacatggcacccaagaagtggaccagaggcttcgtccaacgcctgaagggaaaacagggtcgatttagaggaaatctctcaggaaagagagtggatttttctggcagaacagtcatctcgcccgaccccaacctccggattgatgaggtagctgtgccagttcatgtggccaaaattctaacttttcctgagaaggtaaacaaagcaaacatcaatttcttgaggaaactggttcaaaacggccctgaggttcacccaggagcaaacttcattcagcagagacatacgcagatgaaaaggtttttgaaatacggaaatcgagaaaagatggctcaagagctcaagtatggtgacatcgtagagagacacctcatcgatggagatgtggtgctgttcaatcggcagccctcgctgcacaaattgagcattatggctcatctggccagggtcaagccccaccggaccttcagatttaatgagtgtgtctgtacaccctataatgctgactttgatggtgatgaaatgaaccttcatcttcctcaaacagaagaagctaaagcagaggcccttgttctgatggggactaaagcaaatcttgtaaccccgaggaatggggaaccgctgattgctgctattcaggattttctaacaggtgcctatctcctcactctcaaggacactttctttgatcgagccaaggcttgccaaatcattgcttcaatactggttggcaaggatgagaaaattaaagttcgcctcccaccgcctacaatcctaaagcctgtcaccctgtggacgggaaagcagatcttcagtgtcatcctcaggcctagcgatgacaatccagtgagggccaacctgcgaaccaagggcaagcagtactgtggcaaaggggaagatctctgtgccaatgattcctatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtctaaccgtggtttctcaattgggatcggtgatgtcacacctggccaaggactgctgaaggccaagtatgagttgctgaatgccggctacaagaaatgtgatgagtacatcgaagccctgaacacgggcaagctgcagcagcagcctggctgcactgctgaggagaccctggaggcactgatcctgaaggagctgtctgtgatccgtgaccacgctggcagtgcctgcctccgggagctggacaagagcaacagccccctcaccatggctctgtgcggctccaaaggttccttcattaacatatcacagatgattgcctgtgtgggacagcaggccatcagtggctctcgagtgccagacggctttgaaaacaggtccttgcctcattttgaaaaacactcaaagctcccagctgccaaaggctttgtggctaatagcttttattccggtttgacaccaactgagtttttcttccacacaatggccggccgggaaggtctagtcgacacggctgtaaagacagctgaaacgggatacatgcagcgaaggcttgtcaaatctcttgaagatctttgctcccagtatgatctgacagtccgaagctctactggcgatattatccagttcatttatggaggagatggcttagatcctgcagctatggagggaaaagatgaacctttggagtttaaaagggttctggacaacatcaaagcagtcttcccgtgtcccagtgagcctgctctcagcaaaaacgagctgatcctgaccacagagtccatcatgaagaagagtgagttcctctgctgccaggacagcttcctgcaggaaataaaaaaattcattaagggggtctctgagaagatcaagaaaaccagagataaatatggcatcaatgataacggcacaacagagccccgtgtgctgtaccagctggaccgcatcacccccacccaagtagaaaagtttctggagacctgtagggacaagtacatgagggcacagatggagccaggttctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcagcactccaattatcacagcacagctagacaaggatgacgacgcggattatgctcgcctcgtgaaagggagaattgagaaaaccctcttgggagagatttccgagtatattgaagaagtgtttcttcctgatgactgctttattctcgtcaagctctccctggaacggattaggcttctgagactggaagtgaacgctgagacagtgagatattccatctgcacatccaagctccgtgtgaagcccggtgatgtggctgttcatggtgaggctgtggtgtgtgtcacccccagagagaacagcaagagctccatgtactacgtgctgcagttcctgaaagaggatctccccaaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaaccacctccaataacacctatgaggtggagaaaactctgggcatcgaggccgcccggacaacgatcatcaatgaaatccagtacaccatggtgaaccacggcatgagcatcgacaggaggcacgtgatgctgctctccgacctcatgacctacaagggtgaagtcctgggcatcactaggtttggcctggccaagatgaaggagagtgtgctgatgctggcctcctttgagaagacggctgaccatctctttgacgctgcctacttcgggcagaaggactctgtgtgtggggtgtctgagtgcatcatcatgggaatcccaatgaacattggaaccgggctcttcaagctgcttcacaaggctgacagggacccgaaccctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcgggagagctgagggttttattgtttgcttgcttgaaacctaatctatagacggccccacagctcgtgcacacactgcttccctggacttaaagcccagccaggtgtcatggtccatcccagctcactgcatacatccatcggctccccatggtgtcttcacacctgacgatgagccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggcccaggcagctctgtaacatcttctatagatgcccctggctaccctgttgttttcatctacctcagacccctatcatggggctctaccctgtgacaagagccaaacccattctccatggcctatggaagcctcactggagtttggggcctgctgcaatggggatgagatggttttttgtagaattatacttacgttccttggatgatctctagttgattttttaagttctgagttgatgctgttaaggtacccggggtagccattggttcttggatctgtgttagaatgagtgctttcccttcctactgatgtgattgtggattaggaattcgtgaccgagtgatttttggccagtggttgggtttaaaattctattaaaatttgtagtttgggctgggtgctgtggctcatacctataatcccagcactttgggaggccgaggggggcagatcacttgagcccaggagttcgagagcagcctgggcaacatgacgaaaccccgtctctacagagaatacaaaaattagccaggcatggtggcccatgcctgtagtacctgctattggtaaggctgaggtggaaggttcacttgagcctgggaggtggaggttgtagtgagccaagatcgtgccactacactccagcctgggcaacaaagcaagaccttgtctcaaaaaaaaaaaaagaaaaaaattaagcgtaaaaaaaaattagtttttataaaaaattatagtttgaccttttgatttccctgcatctacaaggtagacctattaacttctcttggggtatcagtgatgtggaaaaaaaatgccatttttcttaatgtttaacccccctttatctttgaattgagctagagcctggtttaggacaaaggattaagtttgttaatgaacactaattcagggcttctacttgagaccccaccgagatcaccagttctcatgtaacctgggaagagccataaaggggtaccccccaccccaactgccttcctggaagcatgcctgggaagtaagctgtaggcctgatccgagccaggaccactgggatccgtgcaaaggccaggggagggtagaattgaatcataggagtgaactccggcacctgttgtcttctgcgggtgacgcacactttaaatggaagagaggttgtggctataacttgtggctgggaataataaagatggcaccgccaaggagcctcaccttgcgtgagtgagtactcagttgggcgctgcagggtctggagtctgtgtgagacgtgtgtgattgtgatgggtgcgaatcagcgtatagcacttgagaacaaggcagaccttggagcagaatggttatgtgaaggatcacatcacccatgggtagggggggaagtcatacgtcctggaggtgctggtcctcctcctggaactgccagccttgctaggactatcaacatcaacagcattgcctggtaaaccctactgtttgtgctccccactgtgtcccatgactggtgttaaaattctccctactttgatcatctgccctgcccaggccttgggctttatgccagcacagagctcaaaggccaggtagcagcacatcctcaagcatgagagctcaaagggttacatttgagtctctgtacctgcttggaagaaataaaaatacgtgtgaattcca

SEQ ID NO: 333759 - DNA, 6501 bp, Homo sapiens
acgtgggacactctacggtggccgagaggatgccgcagatgtgttagcggcgagtccagaagcagccccaggaggtgctgggggcatcgtttctctaatctggcctcccgagtgccaaggaggcgtcccggcagcggtcatcatggtgaaggagcagttccgggagacggatgtggccaagaaaataagccacatctgttttggaatgaagtcacctgaggagatgcgccagcaggcgcacatccaagttgtgagtaagaacctgtacagccaggacaaccaacatgcccccttgctatatggggtgctcgaccataggatgggtacgagtgagaaggatcgtccatgtgaaacctgtgggaaaaacttggctgactgtctaggccactatgggtatatcgacctggagttgccgtgttttcatgtagggtacttcagagcagtcataggcatcttacagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtaccgtaaagaagtgtggactgctgaaaataattcatgagaaatacaagaccaacaaaaaagtggtggatcccattgtatcaaatttccttcagtcttttgaaacagccattgaacataataaagaagtggagcctctgctgggaagggcacaggaaaacttgaatcccttagtagttctgaatttatttaaacgaatcccagctgaagatgttcctctacttctgatgaacccagaagccggaaagccgtctgatttgattctcacacgacttttggtgcctcctttgtgtatcagaccctccgttgtgagtgatttgaagtctggcaccaatgaagatgatctgacaatgaaactgacagaaatcattttcctaaacgatgttattaaaaagcatcggatctcaggagccaagacccagatgatcatggaggactgggatttcctgcagctgcagtgtgccctctacattaacagtgagctctcgggcattcccctcaacatggcacccaagaagtggaccagaggcttcgtccaacgcctgaagggaaaacagggtcgatttagaggaaatctctcaggaaagagagtggatttttctggcagaacagtcatctcgcccgaccccaacctccggattgatgaggtagctgtgccagttcatgtggccaaaattctaacttttcctgagaaggtaaacaaagcaaacatcaatttcttgaggaaactggttcaaaacggccctgaggttcacccaggagcaaacttcattcagcagagacatacgcagatgaaaaggtttttgaaatacggaaatcgagaaaagatggctcaagagctcaagtatggtgacatcgtagagagacacctcatcgatggagatgtggtgctgttcaatcggcagccctcgctgcacaaattgagcattatggctcatctggccagggtcaagccccaccggaccttcagatttaatgagtgtgtctgtacaccctataatgctgactttgatggtgatgaaatgaaccttcatcttcctcaaacagaagaagctaaagcagaggcccttgttctgatggggactaaagcaaatcttgtaaccccgaggaatggggaaccgctgattgctgctattcaggattttctaacaggtgcctatctcctcactctcaaggacactttctttgatcgagccaaggcttgccaaatcattgcttcaatactggttggcaaggatgagaaaattaaagttcgcctcccaccgcctacaatcctaaagcctgtcaccctgtggacgggaaagcagatcttcagtgtcatcctcaggcctagcgatgacaatccagtgagggccaacctgcgaaccaagggcaagcagtactgtggcaaaggggaagatctctgtgccaatgattcctatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtctaaccgtggtttctcaattgggatcggtgatgtcacacctggccaaggactgctgaaggccaagtatgagttgctgaatgccggctacaagaaatgtgatgagtacatcgaagccctgaacacgggcaagctgcagcagcagcctggctgcactgctgaggagaccctggaggcactgatcctgaaggagctgtctgtgatccgtgaccacgctggcagtgcctgcctccgggagctggacaagagcaacagccccctcaccatggctctgtgcggctccaaaggttccttcattaacatatcacagatgattgcctgtgtgggacagcaggccatcagtggctctcgagtgccagacggctttgaaaacaggtccttgcctcattttgaaaaacactcaaagctcccagctgccaaaggctttgtggctaatagcttttattccggtttgacaccaactgagtttttcttccacacaatggccggccgggaaggtctagtcgacacggctgtaaagacagctgaaacgggatacatgcagcgaaggcttgtcaaatctcttgaagatctttgctcccagtatgatctgacagtccgaagctctactggcgatattatccagttcatttatggaggagatggcttagatcctgcagctatggagggaaaagatgaacctttggagtttaaaagggttctggacaacatcaaagcagtcttcccgtgtcccagtgagcctgctctcagcaaaaacgagctgatcctgaccacagagtccatcatgaagaagagtgagttcctctgctgccaggacagcttcctgcaggaaataaaaaaattcattaagggggtctctgagaagatcaagaaaaccagagataaatatggcatcaatgataacggcacaacagagccccgtgtgctgtaccagctggaccgcatcacccccacccaagtagaaaagtttctggagacctgtagggacaagtacatgagggcacagatggagccaggttctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcagcactccaattatcacagcacagctagacaaggatgacgacgcggattatgctcgcctcgtgaaagggagaattgagaaaaccctcttgggagagatttccgagtatattgaagaagtgtttcttcctgatgactgctttattctcgtcaagctctccctggaacggattaggcttctgagactggaagtgaacgctgagacagtgagatattccatctgcacatccaagctccgtgtgaagcccggtgatgtggctgttcatggtgaggctgtggtgtgtgtcacccccagagagaacagcaagagctccatgtactacgtgctgcagttcctgaaagaggatctccccaaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaaccacctccaataacacctatgaggtggagaaaactctgggcatcgaggccgcccggacaacgatcatcaatgaaatccagtacaccatggtgaaccacggcatgagcatcgacaggaggcacgtgatgctgctctccgacctcatgacctacaagggtgaagtcctgggcatcactaggtttggcctggccaagatgaaggagagtgtgctgatgctggcctcctttgagaagacggctgaccatctctttgacgctgcctacttcgggcagaaggactctgtgtgtggggtgtctgagtgcatcatcatgggaatcccaatgaacattggaaccgggctcttcaagctgcttcacaaggctgacagggacccgaaccctcccaagaggcccctgatcttcgacacaaatgaattccacatcccccttgtcacatagtccaagagcagcttctcctctgatagggtgcagctcacaccagtgaccctgactgtgccacgctgctcgggagagctgagggttttattgtttgcttgcttgaaacctaatctatagacggccccacagctcgtgcacacactgcttccctggacttaaagcccagccaggtgtcatggtccatcccagctcactgcatacatccatcggctccccatggtgtcttcacacctgacgatgagccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggcccaggcagctctgtaacatcttctatagatgcccctggctaccctgttgttttcatctacctcagacccctatcatggggctctaccctgtgacaagagccaaacccattctccatggcctatggaagcctcactggagtttggggcctgctgcaatggggatgagatggttttttgtagaattatacttacgttccttggatgatctctagttgattttttaagttctgagttgatgctgttaaggtacccggggtagccattggttcttggatctgtgttagaatgagtgctttcccttcctactgatgtgattgtggattaggaattcgtgaccgagtgatttttggccagtggttgggtttaaaattctattaaaatttgtagtttgggctgggtgctgtggctcatacctataatcccagcactttgggaggccgaggggggcagatcacttgagcccaggagttcgagagcagcctgggcaacatgacgaaaccccgtctctacagagaatacaaaaattagccaggcatggtggcccatgcctgtagtacctgctattggtaaggctgaggtggaaggttcacttgagcctgggaggtggaggttgtagtgagccaagatcgtgccactacactccagcctgggcaacaaagcaagaccttgtctcaaaaaaaaaaaaagaaaaaaattaagcgtaaaaaaaaattagtttttataaaaaattatagtttgaccttttgatttccctgcatctacaaggtagacctattaacttctcttggggtatcagtgatgtggaaaaaaaatgccatttttcttaatgtttaacccccctttatctttgaattgagctagagcctggtttaggacaaaggattaagtttgttaatgaacactaattcagggcttctacttgagaccccaccgagatcaccagttctcatgtaacctgggaagagccataaaggggtaccccccaccccaactgccttcctggaagcatgcctgggaagtaagctgtaggcctgatccgagccaggaccactgggatccgtgcaaaggccaggggagggtagaattgaatcataggagtgaactccggcacctgttgtcttctgcgggtgacgcacactttaaatggaagagaggttgtggctataacttgtggctgggaataataaagatggcaccgccaaggagcctcaccttgcgtgagtgagtactcagttgggcgctgcagggtctggagtctgtgtgagacgtgtgtgattgtgatgggtgcgaatcagcgtatagcacttgagaacaaggcagaccttggagcagaatggttatgtgaaggatcacatcacccatgggtagggggggaagtcatacgtcctggaggtgctggtcctcctcctggaactgccagccttgctaggactatcaacatcaacagcattgcctggtaaaccctactgtttgtgctccccactgtgtcccatgactggtgttaaaattctccctactttgatcatctgccctgcccaggccttgggctttatgccagcacagagctcaaaggccaggtagcagcacatcctcaagcatgagagctcaaagggttacatttgagtctctgtacctgcttggaagaaataaaaatacgtgtgaattcca

SEQ ID NO: 333760 - DNA, 2154 bp, Homo sapiens
tacccctcaggctcttcccgagcagcgtggcacacgtcacgggtccacttggctgtgagctgcaccctatcagaggagaagctgctcctggggatgccaagacgggcttctcttgattgtctggcattaggtggggacctctaggacccccgtcctcagggaagctacaaaactctgttatacatcagctggagcacagggacaaggagtccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggcccaggcagctctgtaacatcttctatagatgcccctggctaccctgttgttttcatctacctcagacccctatcatggggctctaccctgtgacaagagccaaacccattctccatggcctatggaagcctcactggagtttggggcctgctgcaatggggatgagatggttttttgtagaattatacttacgttccttggatgatctctagttgattttttaagttctgagttgatgctgttaaggtacccggggtagccattggttcttggatctgtgttagaatgagtgctttcccttcctactgatgtgattgtggattaggaattcgtgaccgagtgatttttggccagtggttgggtttaaaattctattaaaatttgtagtttgggctgggtgctgtggctcatacctataatcccagcactttgggaggccgaggggggcagatcacttgagcccaggagttcgagagcagcctgggcaacatgacgaaaccccgtctctacagagaatacaaaaattagccaggcatggtggcccatgcctgtagtacctgctattggtaaggctgaggtggaaggttcacttgagcctgggaggtggaggttgtagtgagccaagatcgtgccactacactccagcctgggcaacaaagcaagaccttgtctcaaaaaaaaaaaaagaaaaaaattaagcgtaaaaaaaaattagtttttataaaaaattatagtttgaccttttgatttccctgcatctacaaggtagacctattaacttctcttggggtatcagtgatgtggaaaaaaaatgccatttttcttaatgtttaacccccctttatctttgaattgagctagagcctggtttaggacaaaggattaagtttgttaatgaacactaattcagggcttctacttgagaccccaccgagatcaccagttctcatgtaacctgggaagagccataaaggggtaccccccaccccaactgccttcctggaagcatgcctgggaagtaagctgtaggcctgatccgagccaggaccactgggatccgtgcaaaggccaggggagggtagaattgaatcataggagtgaactccggcacctgttgtcttctgcgggtgacgcacactttaaatggaagagaggttgtggctataacttgtggctgggaataataaagatggcaccgccaaggagcctcaccttgcgtgagtgagtactcagttgggcgctgcagggtctggagtctgtgtgagacgtgtgtgattgtgatgggtgcgaatcagcgtatagcacttgagaacaaggcagaccttggagcagaatggttatgtgaaggatcacatcacccatgggtagggggggaagtcatacgtcctggaggtgctggtcctcctcctggaactgccagccttgctaggactatcaacatcaacagcattgcctggtaaaccctactgtttgtgctccccactgtgtcccatgactggtgttaaaattctccctactttgatcatctgccctgcccaggccttgggctttatgccagcacagagctcaaaggccaggtagcagcacatcctcaagcatgagagctcaaagggttacatttgagtctctgtacctgcttggaagaaataaaaatacgtgtgaattcca

SEQ ID NO: 333761 - DNA, 409 bp, Homo sapiens
cttttggtaagggaagccttggaaggatgtctgctgaaggtgcagagaaaatgcagagctccgttcaaggtgaaaaaagtggttgacaactggcagaaagaagctggccttagggaggaagtcagaagccagggtgctgtaccccttgggctgtgtgttaactcctgggtcactggatcatggggatgtccacagggtccctcgggggtgggttcttgacacccagggtggcagggacctgggccggtggctatttactaaggggtatgaatgtgtcccagcatgttaagatctagtggagctggactgatacctattggccgaatgtgacctctgcctgtttcaaaggtgtttaatcctgatgtctcataaattaagactcaggcctgtaatcccagcactttgggag

SEQ ID NO: 333762 - DNA, 100 bp, Homo sapiens
atgaaaaattcatactgataattatagatcagaatcatttaaagcccttatctccttcctcctctcatttccctaatcttaattctttcctctgaaaaaa

SEQ ID NO: 333763 - DNA, 761 bp, Homo sapiens
gtgcatcacagtctttctgcacttaggatcgctagacagcacttcagccgtgcacgtggggaccattttacacagcaccatccccaagaaaaaggacaaaaatatgaaaaacctggcactaaatggactgtgaaaaggacatttcttcacaaaatgacagttgaaacaggaagtcagagcgttgccttgttcagcctctgctagaaatgtgcttgtcggttgactcaaattttttgccgctctgtgcatgttggtgaatatctgcaaaaggactgtgggtcgggcgcagtgattcatgcctataatctcagcactctgagaggccgaggcgagagggttgattgaggccaggggttcaagaccagcctggtcaatgtagtaagattacatctccacaaaaaataaaaaactagctgggcctgttggcataagcctgtaatccctgcttctccagaggctgatgaggtagaatcccttgagctcaggagtttgaggctgcagtgagctatgactgcatcactgcactccagcctgggacacagagcaagaccctgtctgaacaaattaaaataaataaataaatagggcatggtggcttatgcctgtaatcccaacactgtgggaggctgaggcaggaggattatttaagccctggagtctgagactagcttggacaatgtagtgagacctctactctataaaacataaaaataaaaaataaaataaataatagccagtttgaaaaatgcttacccagtaag

SEQ ID NO: 333764 - DNA, 541 bp, Homo sapiens
tgtggggtctactggccacacctgatgtcaaagtacaacaggaggaggctgagtggggagccaggctggccgcttccactggccaggcagaacgaaggggcattccgaggaacctgaaccttggagtggctggggcgtgagcaagccagggtcctacggtgctgggtgcaacaggaaaacccagggctgatgggtgaggtttgaggctgacctcagtctcccgtctgtggaatggggacaagggccctgagacactgcagagcggctcagagaagcctcctgggccagtggttctggagaaacacagctgcctatggggtgaaggggaaagcagggctgcagagtcagcgccttccctgcgggcgggccagccacctcagctgcacccccaagtcgggggggtccctaaagctccagctcatgctctgggtgacacactgggtgtggagggcattgtccctgggccactcaatgaggacatccaggcagggccacagccatcgctaatgtcactaacgcacacccccacctagtgttcagc

SEQ ID NO: 333765 - DNA, 191 bp, Homo sapiens
aaaaacctgcacagctttgaggtggaaattttatgatattcaattgatatcatgattagttttaaaactatagagctagatcaactcagaattatcaagtagacagtttattgctctctctgtacccttccttcctggagaaatctcaagtacttactttcttcacacttttttttttttttttttttttt

SEQ ID NO: 333766 - DNA, 313 bp, Homo sapiens
ccatttgtttctagtttgttgagtttttaaaaaatcataaatggatgtcgaatttcagtaatagctcttccctttaaaatgtttacgtggcaaattttattgattgatttttcaacataagccaaatgtattggtgaatgtagtaactcattgctttttttaactagaattttccccattatgagtgaggttgagtatctttcttttagtgtgcttattggctatttggatatccagtttgtaaaatgcctgttcaagtcccctctccctttttacaaaatcaggttgcctgaccttctcgtattgatttata

SEQ ID NO: 333767 - DNA, 442 bp, Homo sapiens
aaaagaaaagaaaagaaaactgtcataactgtattactcaaatatttcctcttctctcatttgctaaaaatatatagtaaaactttcatgcctatttaaaacaatctctaggccgagtgcagtggctcatgcctgtaatcccagcattttgggaggttgaggcaggcggatcatgaggtcaatagatcgagaccatcctggccaacatggtgaaaccccgtttctactaaaaatacaaaagttagctgggcatggtggcgtgtgcctgtagtctcagctacttgggaggctgaggcaggagaatcgcttgaacccgggaggtggaggttgcagtgagccgagattgcgccactgcgcttcagcctggtgacagagcgagactctgtctcaaaaaaatgaatgaataaaacaatctgtagattgctatttttaagaaattgcg

SEQ ID NO: 333768 - DNA, 881 bp, Homo sapiens
tgcttctctcctcctgtcccatgtacaagccacacgtccttgagcacccgctatgcgcaggataacgtccttgcttctttagggcagtgacttttaaactttgttgacgataatctaaaaagaaatgcattttacatgagtgacccagcacatacatatagctagatattctgtatatttgactaaaacagaaattgtgcagaatgattttatccttactgcaggtgctacattctgatgctttctattacattcaattctgttttgttttacaaatgctggttgtactcacagcatggatttcatgatcccctgacatgatcctgatttcataatccagcgactcttagcccaggggcctttaaaaaactacgcctgcctggcttgacccccagaggttgtggtttcatttactgtcggattctgatgtgcggctgcagtttgagaaccactgcactaatgggtcatgatccacagtttaagaaactgtattactgtgatacgtaatacaaagaggaattgatcattcagtaagagccgtcaaatgcggacacaagagttatgaaggtgaagggagggagcagccacacccaactggttagatccaaaaagacctctgggagggaggggcaagctggagtttgagcaagatttaaagagggtagaatcatatagaaaggtgaactagacagaggacaaaggcagattcattcttgtacttactgaacctgtggctatggtactaaaataattttaataactggaacttcctctcacatacttgtggatactactctgttttatttttttgagagagtctcgccttgtcacccaggcaggaatgcaatggtgtgatctcagctcagtgcaagcttcgcctc

SEQ ID NO: 333769 - DNA, 1342 bp, Homo sapiens
agcgggcggggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggtaggaccaccacacttggtccacttacttataataaacattgatttggtcgttca

SEQ ID NO: 333770 - DNA, 627 bp, Homo sapiens
caggcatgagccactgcacccagccttatttatttattttttaagagacagatttcaccatgttggtcaggctggtcttgaactcctggcctcaagtgatctgcccacctcggcctcccaaagtgctgggattacatttgtgagccaccacacctggccaagaataccttgttaaattttttaacctgatagtgtattcagggtttatggctcatttagtttgagagtgttaagagactggagttttaatccaataggtgtttcttttggttctcagatatacatacaagctgtgattgtttagatgtttccatctttttatatatgcatatacatattattattgttgttttttatttttaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaa

SEQ ID NO: 333771 - DNA, 1262 bp, Homo sapiens
agcgggcggggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaa

SEQ ID NO: 333772 - DNA, 2635 bp, Homo sapiens
agcgggcggggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaagtgtatctttacagcagtattaaacatacagctactataattaacccaccttaaatctctttttcttagtacatgagtatcttctagcagttaagaaaggcagtcttcagaaaatggagaactgtggcggaatgcagtacacaacagtatttaggacaactcctttgccaacacaatggctcccctcgctggtgaaagatctctttacagcttaggaaaaacaacggaaattagtttctgatgtcattgctgagctcggcactggttacattgcagaggcagtgtaggatgtctgcaggtttagagactcatttcacaaggcaccagtagtgaattatcaagaaacatttaagaggaaaatgatttctcattgaatatggtacaacaagcacttttttcataaggtctagaagaatgggtagtcatgacaaagaatggaaaagtattgtcatttgttgtaagcatcactacttttttttttttttcagacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggagtgtcggctgtgccccttgtgatggatgaggaaaggtatccacctttctgaatcagacacaagctgcagtagcttcctgatgcctcattcaccaggatgggtaactttaaagacaagttttataactggcatcccatctggtttcagagtcttgggggcttttttcatacagctttgtctgatatttagagacattcagattcagaagccatgagttcagttagctcatgggccgggcacgtgcactgactcactggctgcagcagaacacattgagggagtcttggtgcacttaggtcactgtaaggttctagggctgggagctgggatttgaaccaggatctgtcagcgcagccccagtgctgtgcttgaagcctcgtgccacactggctttgaggtagcacgctgcaagttagtgagtggagttgcccaagtctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtcatgg

SEQ ID NO: 333773 - DNA, 2348 bp, Homo sapiens
agcgggcggggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaagtgtatctttacagcagtattaaacatacagctactataattaacccaccttaaatctctttttcttagtacatgagtatcttctagcagttaagaaaggcagtcttcagaaaatggagaactgtggcggaatgcagtacacaacagtatttaggacaactcctttgccaacacaatggctcccctcgctggtgaaagatctctttacagcttaggaaaaacaacggaaattagtttctgatgtcattgctgagctcggcactggttacattgcagaggcagtgtaggatgtctgcaggtttagagactcatttcacaaggcaccagtagtgaattatcaagaaacatttaagaggaaaatgatttctcattgaatatggtacaacaagcacttttttcataaggtctagaagaatgggtagtcatgacaaagaatggaaaagtattgtcatttgttgtaagcatcactacttttttttttttttcagacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacagggtctcctctgtcacccaggctggagtgcagtggtgcagtcatggctcacggcatccttgacctcccaggctcaagatcctcccccgtcagcctcctcagtagctgagatgacaggcatgtgccaccatgcccggctgtgttttgattttttttttttgtagagatgaagtctcactatgttgcccaggctggtctcaatctcctgggctcaagtgatcctcccacctcagcctcccaaagtgttgggattacaggccctagccaccatgcctgacctaagatcagttttcttaaatttgacagttgctacttttcaaaattcaaacctttctaaataaaagtaagttgattatttgcaaaaaaattctt

SEQ ID NO: 333774 - DNA, 1943 bp, Homo sapiens
agcgggcggggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggagtgtcggctgtgccccttgtgatggatgaggaaaggtatccacctttctgaatcagacacaagctgcagtagcttcctgatgcctcattcaccaggatgggtaactttaaagacaagttttataactggcatcccatctggtttcagagtcttgggggcttttttcatacagctttgtctgatatttagagacattcagattcagaagccatgagttcagttagctcatgggccgggcacgtgcactgactcactggctgcagcagaacacattgagggagtcttggtgcacttaggtcactgtaaggttctagggctgggagctgggatttgaaccaggatctgtcagcgcagccccagtgctgtgcttgaagcctcgtgccacactggctttgaggtagcacgctgcaagttagtgagtggagttgcccaagtctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtcatgg

SEQ ID NO: 333775 - DNA, 2581 bp, Homo sapiens
agcgggcggggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaagtgtatctttacagcagtattaaacatacagctactataattaacccaccttaaatctctttttcttagtacatgagtatcttctagcagttaagaaaggcagtcttcagaaaatggagaactgtggcggaatgcagtacacaacagtatttaggacaactcctttgccaacacaatggctcccctcgctggtgaaagatctctttacagcttaggaaaaacaacggaaattagtttctgatgtcattgctgagctcggcactggttacattgcagaggcagtgtaggatgtctgcaggtttagagactcatttcacaaggcaccagtagtgaattatcaagaaacatttaagaggaaaatgatttctcattgaatatggtacaacaagcacttttttcataaggtctagaagaatgggtagtcatgacaaagaatggaaaagtattgtcatttgttgtaagcatcactacttttttttttttttcagacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggagtgtcggctgtgccccttgtgatggatgaggaaaggtatccacctttctgaatcagacacaagctgcagtagcttcctgatgcctcattcaccaggatgggtaactttaaagacaagttttataactggcatcccatctggtttcagagtcttgggggcttttttcatacagctttgtctgatatttagagacattcagattcagaagccatgagttcagttagctcatgggccgggcacgtgcactgactcactggctgcagcagaacacattgagggagtcttggtgcacttaggtcactgtaaggttctagggctgggagctgggatttgaaccaggatctgtcagcgcagccccagtgctgtgcttgaagcctcgtgccacactggctttgaggtagcacgctgcaagttagtgagtggagttgcccaagtctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtcatgg

SEQ ID NO: 333776 - DNA, 1764 bp, Homo sapiens
gggcgcgaggctcgcctggaagccccggccccagccctggctccgaccccgacggctgtccaagcccgggggacgcgaccttcccggcctctggcctgggcggccccgccgcgggacggaggcggtggtgactcagccgtgccgcagtggcggggcgggggacggggcggcgccgagaccccggccctccgcgccacggagcgggacccacggctgcgggctccacctttcctgtgcccgccgggagggagcggcaggctcggcgtcggcccattgctcttcagcctcccttcaggaacgcccctgtcgcaggaagagcggcgagggaaggccccgttgcattagctaggcctggctgccttttgaagtcagcctttaaagtttgttggacagcaggtagcctcagtcttcagacttaacctgttgccggagacagagatttcctgttccatgaactggtgtagtgagagtctgttcagatttggcgccggtgtccaggtcttcaatccctgggaagactgcaaaaggagatccagaggaatgcatagaaagcgttttctgggtggactagaagctctgaactgcaagcatgcttacgagtaaatgcttactagcgtgcgtgcctgcagggaaaggtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaa

SEQ ID NO: 333777 - DNA, 976 bp, Homo sapiens
agcgggcggggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacagggagccaaatgtgggttccgcaaacaattctggaatactaataggccgggggtgatttgaaaccttccgtttatttgggggtgaaaaaatcggcaagggttgctactcaaattgggccacccctcactgtttttggggggcttgtggaggttgatatttttagg

SEQ ID NO: 333778 - DNA, 1545 bp, Homo sapiens
atacacaatacaatactatttggctattttaaaaaaggaaatggtcttattcacaacaacatggatgaacctggagaacatgatattaagtgaaataagccaagctcataaaaacaaatactgaatgattttacttgtatgtgggatctaaaaatgtccaattcacagaagcaaagactagactagtggttgccagaagctagagggttaagggattggggagatgttactgaaataacacaaaatttcatttagacaggaggaataactttaagagatctattgaacatcacagtgagaacaatatattgtatatactaaaattaccaaaagaataaattttaagtgctctcaacacaactgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaa

SEQ ID NO: 333779 - DNA, 2000 bp, Homo sapiens
caggcatgagccactgcacccagccttatttatttattttttaagagacagatttcaccatgttggtcaggctggtcttgaactcctggcctcaagtgatctgcccacctcggcctcccaaagtgctgggattacatttgtgagccaccacacctggccaagaataccttgttaaattttttaacctgatagtgtattcagggtttatggctcatttagtttgagagtgttaagagactggagttttaatccaataggtgtttcttttggttctcagatatacatacaagctgtgattgtttagatgtttccatctttttatatatgcatatacatattattattgttgttttttatttttaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaagtgtatctttacagcagtattaaacatacagctactataattaacccaccttaaatctctttttcttagtacatgagtatcttctagcagttaagaaaggcagtcttcagaaaatggagaactgtggcggaatgcagtacacaacagtatttaggacaactcctttgccaacacaatggctcccctcgctggtgaaagatctctttacagcttaggaaaaacaacggaaattagtttctgatgtcattgctgagctcggcactggttacattgcagaggcagtgtaggatgtctgcaggtttagagactcatttcacaaggcaccagtagtgaattatcaagaaacatttaagaggaaaatgatttctcattgaatatggtacaacaagcacttttttcataaggtctagaagaatgggtagtcatgacaaagaatggaaaagtattgtcatttgttgtaagcatcactacttttttttttttttcagacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggagtgtcggctgtgccccttgtgatggatgaggaaaggtatccacctttctgaatcagacacaagctgcagtagcttcctgatgcctcattcaccaggatgggtaactttaaagacaagttttataactggcatcccatctggtttcagagtcttgggggcttttttcatacagctttgtctgatatttagagacattcagattcagaagccatgagttcagttagctcatgggccgggcacgtgcactgactcactggctgcagcagaacacattgagggagtcttggtgcacttaggtcactgtaaggttctagggctgggagctgggatttgaaccaggatctgtcagcgcagccccagtgctgtgcttgaagcctcgtgccacactggctttgaggtagcacgctgcaagttagtgagtggagttgcccaagtctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtcatgg

SEQ ID NO: 333780 - DNA, 1190 bp, Homo sapiens
gggcgcgaggctcgcctggaagccccggccccagccctggctccgaccccgacggctgtccaagcccgggggacgcgaccttcccggcctctggcctgggcggccccgccgcgggacggaggcggtggtgactcagccgtgccgcagtggcggggcgggggacggggcggcgccgagaccccggccctccgcgccacggagcgggacccacggctgcgggctccacctttcctgtgcccgccgggagggagcggcaggctcggcgtcggcccattgctcttcagcctcccttcaggaacgcccctgtcgcaggaagagcggcgagggaaggccccgttgcattagctaggcctggctgccttttgaagtcagcctttaaagtttgttggacagcaggtagcctcagtcttcagacttaacctgttgccggagacagagatttcctgttccatgaactggtgtagtgagagtctgttcagatttggcgccggtgtccaggtcttcaatccctgggaagactgcaaaaggagatccagaggaatgcatagaaagcgttttctgggtggactagaagctctgaactgcaagcatgcttacgagtaaatgcttactagcgtgcgtgcctgcagggaaaggtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagcttctttgattagcccaaaacaataaacagaagctgtagctttaatatctacacacagaccccactgcaccccaggcccactgtgggcatggtggcatcgaggagggtggtagctggttgggtatagagaggagctagacaggaatgctgggcaggaatgccagggtctgctcaggggcatgaacaaaactgccccgaaaagtgggttgctgactgccctcaggccttcctcttgcctcaatccatgagagaattttctgaggtcagatcttcgactttttatgtggaaaacaatagcaagtagtactacttctagttatgttgtaaaataaaagtttttttttttttttacatttttttttgagagagtttcgctcttgttccccactggagtgcaat

SEQ ID NO: 333781 - DNA, 402 bp, Homo sapiens
gccggtgtccaggtcttcaatccctgggaagactgcaaaaggagatccagaggaatgcatagaaagcgttttctgggtggactagaagctctgaactgcaagcatgcttacgagtaaatgcttactagcgtgcgtgcctgcagggaaaggtctgcacgtggactctccgtgataataccacctcacattgtagactactccaaggactgagttgttctcttagttgtattattagcggttgttatgggaactcttatgtcggattgcctgggatccagtcccaccgcagccactcagtagccatgtaacccctgggcacgtttcatgcccaagcctcagtttcccgacggtgacatagattagcacctgttagtacctcagggttgttgtgagggttaaatg

SEQ ID NO: 333782 - DNA, 243 bp, Homo sapiens
tctagaggatcccacatgatagctccacgctccatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtggacaatcatgtgggataccgacgctcg

SEQ ID NO: 333783 - DNA, 1599 bp, Homo sapiens
atacacaatacaatactatttggctattttaaaaaaggaaatggtcttattcacaacaacatggatgaacctggagaacatgatattaagtgaaataagccaagctcataaaaacaaatactgaatgattttacttgtatgtgggatctaaaaatgtccaattcacagaagcaaagactagactagtggttgccagaagctagagggttaagggattggggagatgttactgaaataacacaaaatttcatttagacaggaggaataactttaagagatctattgaacatcacagtgagaacaatatattgtatatactaaaattaccaaaagaataaattttaagtgctctcaacacaactgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaa

SEQ ID NO: 333784 - DNA, 2972 bp, Homo sapiens
atacacaatacaatactatttggctattttaaaaaaggaaatggtcttattcacaacaacatggatgaacctggagaacatgatattaagtgaaataagccaagctcataaaaacaaatactgaatgattttacttgtatgtgggatctaaaaatgtccaattcacagaagcaaagactagactagtggttgccagaagctagagggttaagggattggggagatgttactgaaataacacaaaatttcatttagacaggaggaataactttaagagatctattgaacatcacagtgagaacaatatattgtatatactaaaattaccaaaagaataaattttaagtgctctcaacacaactgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaagtgtatctttacagcagtattaaacatacagctactataattaacccaccttaaatctctttttcttagtacatgagtatcttctagcagttaagaaaggcagtcttcagaaaatggagaactgtggcggaatgcagtacacaacagtatttaggacaactcctttgccaacacaatggctcccctcgctggtgaaagatctctttacagcttaggaaaaacaacggaaattagtttctgatgtcattgctgagctcggcactggttacattgcagaggcagtgtaggatgtctgcaggtttagagactcatttcacaaggcaccagtagtgaattatcaagaaacatttaagaggaaaatgatttctcattgaatatggtacaacaagcacttttttcataaggtctagaagaatgggtagtcatgacaaagaatggaaaagtattgtcatttgttgtaagcatcactacttttttttttttttcagacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggagtgtcggctgtgccccttgtgatggatgaggaaaggtatccacctttctgaatcagacacaagctgcagtagcttcctgatgcctcattcaccaggatgggtaactttaaagacaagttttataactggcatcccatctggtttcagagtcttgggggcttttttcatacagctttgtctgatatttagagacattcagattcagaagccatgagttcagttagctcatgggccgggcacgtgcactgactcactggctgcagcagaacacattgagggagtcttggtgcacttaggtcactgtaaggttctagggctgggagctgggatttgaaccaggatctgtcagcgcagccccagtgctgtgcttgaagcctcgtgccacactggctttgaggtagcacgctgcaagttagtgagtggagttgcccaagtctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtcatgg

SEQ ID NO: 333785 - DNA, 1455 bp, Homo sapiens
agcgggcggggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattacggggtctggctctgtcacccaggctggagtgcagtggcacgattatggctcattgcagcctcgacttctcggggccaagcgatcctcctgcctcagccttctgagtagctgggaccacaggcgtgcaccaccatgcccacctaattttttatttcttgtagagatgaggtctcctgcctcagcctcccaaagtgctggaatttacaggtaggaccaccacacttggtccacttacttataataaacattgatttggtcgttcaaaaaaacaaaaaaaccgagaattatgcgggggggaaacacagatggaagggccctgtaagtgtagaaccagttttttaaaggaaagcgcccaaagagcatatattaagcggac

SEQ ID NO: 333786 - DNA, 1165 bp, Homo sapiens
agcgggcggggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaagacggggtctggctctgcactccagcctgggcgacagagcgagacttggtctcaaaaaaaaaaaaaaaggatttaaatgtattttcaagcattgatattgtcataaaatgtaattcactgataaaatgcactccagcctgggcgacagagcgagacttggtctcaaaa

SEQ ID NO: 333787 - DNA, 1688 bp, Homo sapiens
atacacaatacaatactatttggctattttaaaaaaggaaatggtcttattcacaacaacatggatgaacctggagaacatgatattaagtgaaataagccaagctcataaaaacaaatactgaatgattttacttgtatgtgggatctaaaaatgtccaattcacagaagcaaagactagactagtggttgccagaagctagagggttaagggattggggagatgttactgaaataacacaaaatttcatttagacaggaggaataactttaagagatctattgaacatcacagtgagaacaatatattgtatatactaaaattaccaaaagaataaattttaagtgctctcaacacaactgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagcctccaggcatcttttgaaatgtgcaacaaaataaaaacctctgaacctgttttgacactgcaaactcagtggatgacatgccagcccattggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaa

SEQ ID NO: 333788 - DNA, 501 bp, Homo sapiens
tctagaggatcccacatgatagctccacgctccatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaa

SEQ ID NO: 333789 - DNA, 674 bp, Homo sapiens
ctcaagaaatcagcaagtgacatagctcctcccctgggaatttcacatctggaagcctgatgtcccaggacacagtggtcatttctacttccagcccctgttggcattggagctggaggcctggaagctgcggctcccttcaccaagaagagaacctgatgttgaagctcctggctcatgccctgcccccaactcaggacctgaggagggctcctgctgcgctctggccctctggagttcagagctgcagcctctccatccaccatgggccaggtctgggtgccccccaggtcactgcttccaaagcagctcagctgactttgcctccatgactttttaattttgacaccattagttgtaggagaggtgatttctctaccattttaaagtctaagaaagaaactgaggcaacagaaggtgtgcccctcagacagtagaatgcagccctttgcttactaggacacactggaatcacatggttcaggagggctcagctctgacatttcctgggagcctctcttttcatggggggcagtggaatcccagtttaaatgctggtctgggtcaggttgcttcttaccatcaagcaatttccatcaaatatctttggggtcatgatcggggcaacccacccccaccatagttacagaaaacagggtaccatcagacaagaa

SEQ ID NO: 333790 - DNA, 391 bp, Homo sapiens
atctctactatctccatcaaaattgtccaaaatcagactcatggttttcccttgcccatattcaggatcctaaattatgatcagaattactcccctaaatctccttgccagttccactcttaggattaccactactgacttatcatgttagcactaagttgtagttctgctttcccccacctcccaccatcatggtctagtctacaagactgcgtttctgctatggttgctgtttataattggattggaatcggtggaagtctatggaccatggtgtagttattctggaatttatagatcagtaagatagttattctggtcttaactgggctcacttaggcatctatggttagctatgggtctggaagtttgccctgctgatcttggctgg

SEQ ID NO: 333791 - DNA, 309 bp, Homo sapiens
gctaacgatgttgaacatcttttcatgggtcttataaggtggagaagtggttgaaattgggcaggttatgacagagtttatagctttggtttggtggctccaacaaagcctaaatattgaagcagagtattgataagaaaactgtggaacgtatacaccatggaattactaggcagccataaaaaaggatgagttcctgtcctttgcaggaacgtggatgaacttggaaggcatcattctcagcaaactgacacaggaaccgaaaaccaaacaccgtatgttctcactcctaagtgggagttgaactgt

SEQ ID NO: 333792 - DNA, 426 bp, Homo sapiens
tgtttcttctaccaaactacctttccaggatatctacagttggtgttcaagccattgcctctgggcttcatgtgagcattcttgccccgggcaggaattctgcagcacaaaacaaagtactaaagattttaccctttgagaagcctactccttaagggaatattacctcccaggtttagcagttgggaagacatgaagtacctgttctcatttcattcaaatgccattcagtggtctgtgagtctacatgaaatgactccctgcggacagcaccctcccccagtctgaccacctactacttcctcccaggtcactcccttgcagccacgcaggcttctttgctctttcctgaaaatgtcaattatgatctgccttggtctctgcactgcctctgccacatagagtcatggttcgttttcactcctc

SEQ ID NO: 333793 - DNA, 288 bp, Homo sapiens
ctcagaactctctgtaggatccacatctggagccaagaggccgctctgtgccaccacactccccggagtgtccatcgtgcattggagggggacggtgttggcctcaagtgctgccctcgcagctcccgttcacagaccatgactgagaggactctcagcagaggaccctggggtgacatttctactgctggtgcctcataaggctggccaggggcaggaggcccagggctgagtccaaggaatggggtggggtttcctcattccttgctgtcttcatacttggccttc

SEQ ID NO: 333794 - DNA, 520 bp, Homo sapiens
actacaggcacgtgccaccatgcccggctagtttctttaatttttttgtagagacggggtcttgccatgttgcccaggcttgtcttgaacccctgggctcaagggatcctcctgccttggcctcccaaagtgttgggattacaggatgtgagctaccatgcctggctggctataaatcttaagatagctttatttttctctgggagtataccattttctgtggcttatagtatttatgtagcggagtaactgctttctccacagaattactccacaaatgcagttgatctagttgttttgtagtgagaaggtgcttcagaatatctcatttgatataccaccagaagcagaaaactcaatgactttaaaagtcatttggttctttacagtttactatttggttccatacaaatctgttcgttatggtttcttactctttttttaaaaatagttttcagtttttttatatgtctctgatcatttaaaacgtattttacgttctctttagtattgtttaata

SEQ ID NO: 333795 - DNA, 465 bp, Homo sapiens
caataatgtctttctgtccatgaatttgaaatatctctatatttattcagatcttttgaagaatttcttaattagagctgtatagttttcctctaagagattgtttacataattgttagatttatacctaagtattttactttttctggtactaatataaatggtattaagttctttatttcaaattctaaatgttcatgctggtatatagaaagacattgactttgatatgttagccttgtattctgcaaccttgctataatcacttattatttcaaggagttatttttcgttgactctttgggatcttatgtatagaacatcatgtcatctgtgaacaatcagttttgtctctttcttcccaacctatatatctttttctctttttttattgcattagctaagaattttagtacactgttgaataggtgtgatgagaggtgaaattgttgccttattcccaat

SEQ ID NO: 333796 - DNA, 372 bp, Homo sapiens
gaatatgaattgttttgctttacttcttactatgcatgaaactgtctatgctatatcttgtacaaaataagaagtcacatgcatatagacacaattttcattcttttaaagaatactttacagttaagcctatttgaaaagaagttttaagcttcctggaaaaaaagctgtgcttggaatatttattaaatggcaaaaggcaaaccaaatgtgcatgcaatctaatgaagagtaaaattgtgagtaataatttaatacttcaagttaatagattgtttaataattaaaatcagctgcttgccccacattgtgacacctgaaaaacagaaagcgaatcacctagaaccaaggcaaagttagagttgatgcttc

SEQ ID NO: 333797 - DNA, 6082 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggtcggttccgagggggtgggtgtaagggtgaggtgggggtgtgtgtgccgtgtatgtgtgtaggggtgtggtggggtgtggcgtgtgtgtatgatgtatgtgggctgtgtatctggcacatgtgtgttgggtggtgtgtgtggtgtgggcgcgtctgtggtgtgtgtcctagtcacttggagaagggtgtgtgtgggatgcgtgtgtataagggggtgtgtgtgggatgcgtgtgtataagggggtgtgtgtagtgtgtgttgggtgtggggtgtgtacacctggcatctgtggcatgtgttctggtcacttggagaagggcatgtgtggggtgtgtgtgggatgtgggttgtgtgtatatctggcatgtgtcccagtcacttgcagaagggtgacttcttgccagccgcatcgagatgccatgcattgggttcctaggttggactcatacccgagggtggcagtgggaagattcgggtctcgtttctctctgtcaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcaggatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttaaag

SEQ ID NO: 333798 - DNA, 4650 bp, Homo sapiens
gtcacttttgaagaatggtgggacagtagatggtggcagttgatttttcattttctaactttgcagaataaaaattgaatgatcctgtattggtcccccaagtatttcagagctcccggagtctgggaagtgccatggtaaatagtcacacaggccagatgagagactgaggtgtgcatgttctgtgggaggggaagtgtagcctgcgggtgtggaatggtctgggtggccgtgggaaacgtggagagagccctggaaacagccccgctttgtgccagtgaggagtcggggaagcagctggggagacggggctggagagcctggggagaggggaagctcttctggagggagtgggtgcaccggcgcactgcgcagcctcctagtaaagggcctgcagacccagctggcctcatgcctggaggccttaggcgactctgaggaaggcagttccagagcagtgagtcaggaccagatgcagtgggttgcaagtagaaccaggagcagagactggatgtggtgtattgtttcagaaccttccagcgtgagtagctaccatatggatacgtaggcgtgggaggcgccaggcagccccgggtccgggtgagaagaggccccagagctcagagtgcctcagatcccagttagtgagcggtgcgggggacatgaatgagggcagggctcctgaccccgaagcccacgtctgactccgctgtcctctctgagacgggtgcagagccggggagatttggtcctgtttgtgcctttgttcccacccccacccctcttcccagattggggaccagctgtctgtgaccagcagagaagtggaagggtgggctgggtgggcgccctagctcagggggatgtttggcctcccgcctcactctagatttgggtacttactttttattgagaccaaaaagaaaaggcaacactgggtgaggatacacgtacatttctcggggcttttattttctgtgaagtgggtggcagtgggcattgtgaaggtttgaaatggctactgtgggtagtggggccctgaggaggtcagagctctgcagagagactgccaggcagcgtgggctgaggatggaggttaagggtctgtggtgactcgggtggggggtggagtttcccagcctcacgctgagcttgtgactggtgggcatggggctgctgggatggggccatccctcgtgtcatcttgctgagcccttcccttaaaggctggggtctccttttcaggttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcag

SEQ ID NO: 333799 - DNA, 470 bp, Homo sapiens
aggtcccaccctaatgatctcatgttaacttgattacatctgcaaagaccccacttccaaataaggtcaccattcacaggtactggggcttaggacttcaacatatcttttgttgggacatgactcaacccataacagtatggaaaggttctcttctcagagttaaatgtggctcccaatctctacctcacagatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttaaag

SEQ ID NO: 333800 - DNA, 357 bp, Homo sapiens
tttaaaccctcagccgtggcacgaaggtggcttctgtccgtggcaggatccagaacagctgcttctgagggttggggcagggtgaggagccccacacatgctgtgtcttgggtagggaaggggcagagtgacgaagctcttccaacctgggtaatgtcacttcttgctcagagcatgtttttattcagacttcgagaccaaacatgacatctttgttcctcagacgagggcatgggtttagaaagaactgaactctttggctgtggtttagggtttagctaagagggcatcgctggggagccccacgtgttgccaagatcttggtgcaataaaatactccggttttgtgaaaaaaaa

SEQ ID NO: 333801 - DNA, 228 bp, Homo sapiens
gaccccatgcttcacgacgacataccaacccttgccaattcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaagctcaagcatgcgggatcctctagat

SEQ ID NO: 333802 - DNA, 5957 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 333803 - DNA, 6200 bp, Homo sapiens
gtcacttttgaagaatggtgggacagtagatggtggcagttgatttttcattttctaactttgcagaataaaaattgaatgatcctgtattggtcccccaagtatttcagagctcccggagtctgggaagtgccatggtaaatagtcacacaggccagatgagagactgaggtgtgcatgttctgtgggaggggaagtgtagcctgcgggtgtggaatggtctgggtggccgtgggaaacgtggagagagccctggaaacagccccgctttgtgccagtgaggagtcggggaagcagctggggagacggggctggagagcctggggagaggggaagctcttctggagggagtgggtgcaccggcgcactgcgcagcctcctagtaaagggcctgcagacccagctggcctcatgcctggaggccttaggcgactctgaggaaggcagttccagagcagtgagtcaggaccagatgcagtgggttgcaagtagaaccaggagcagagactggatgtggtgtattgtttcagaaccttccagcgtgagtagctaccatatggatacgtaggcgtgggaggcgccaggcagccccgggtccgggtgagaagaggccccagagctcagagtgcctcagatcccagttagtgagcggtgcgggggacatgaatgagggcagggctcctgaccccgaagcccacgtctgactccgctgtcctctctgagacgggtgcagagccggggagatttggtcctgtttgtgcctttgttcccacccccacccctcttcccagattggggaccagctgtctgtgaccagcagagaagtggaagggtgggctgggtgggcgccctagctcagggggatgtttggcctcccgcctcactctagatttgggtacttactttttattgagaccaaaaagaaaaggcaacactgggtgaggatacacgtacatttctcggggcttttattttctgtgaagtgggtggcagtgggcattgtgaaggtttgaaatggctactgtgggtagtggggccctgaggaggtcagagctctgcagagagactgccaggcagcgtgggctgaggatggaggttaagggtctgtggtgactcgggtggggggtggagtttcccagcctcacgctgagcttgtgactggtgggcatggggctgctgggatggggccatccctcgtgtcatcttgctgagcccttcccttaaaggctggggtctccttttcaggttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 333804 - DNA, 4738 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcag

SEQ ID NO: 333805 - DNA, 4416 bp, Homo sapiens
cattggtgtgaatcagagtcctccccaccttccaggaaatgcagagtagggcactgggcttcctcctgggcaccataagccccgaagctgcaccggcctccactactccctgggcccagtcctcagcctccaagccctccgaggagctctcctcatcttcctcctcactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 333806 - DNA, 4976 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcataggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 333807 - DNA, 4177 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcaggatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttaaag

SEQ ID NO: 333808 - DNA, 4093 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagcctcctggagacaaggcgtcccttcccgggagctgtcggtctggatctgagggagctctctgtgtgggctctgctgtgctgggagcctgtcacgatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttaaag

SEQ ID NO: 333809 - DNA, 3069 bp, Homo sapiens
gtaaaaagatcgttaaataaatgccttcagccatcgccatgcagaaataaatatctatcctccagacgcagtagcaaccgcgctgcgcccaaagtccccacggccacgcctaaccattataaaagtgttcagcgagagtgttggcgtgagtgtgaatgggtgtgcgctggggggcacggtggagcggtatgggccttcggcgtgtgcatgcacacgccgaatgcccaaactcgacggaacttctggtctgtgactcacccagcaaaggctgccagcctcagctatcgccgctgactgtgcccctgtggaaggaggtcggttccgagggggtgggtgtaagggtgaggtgggggtgtgtgtgccgtgtatgtgtgtaggggtgtggtggggtgtggcgtgtgtgtatgatgtatgtgggctgtgtatctggcacatgtgtgttgggtggtgtgtgtggtgtgggcgcgtctgtggtgtgtgtcctagtcacttggagaagggtgtgtgtgggatgcgtgtgtataagggggtgtgtgtgggatgcgtgtgtataagggggtgtgtgtagtgtgtgttgggtgtggggtgtgtacacctggcatctgtggcatgtgttctggtcacttggagaagggcatgtgtggggtgtgtgtgggatgtgggttgtgtgtatatctggcatgtgtcccagtcacttgcagaagggtgacttcttgccagccgcatcgagatgccatgcattgggttcctaggttggactcatacccgagggtggcagtgggaagattcgggtctcgtttctctctgtcaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 333810 - DNA, 2091 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagacggagtctcattctgtcgcccaggctggagtgcagtggcgcaaccttggctcgctgcaacctccacctcccagtggagacggggtttcactttattagccaggatggtctctatctgctgacctcctgatccacccgcctcagcctcccaaagtgctgggattacagacgtgagccactgtgcccggcctgttctcacatttaacggggaaaatgtgagtagtttgtaccaatgttaatttcctgatttgggtaattctgctgtggttatgtaagagagtgtctttgttctttggaaatacacatggacatattttggggtaaaagaacatcatgtctgcaatttac

SEQ ID NO: 333811 - DNA, 313 bp, Homo sapiens
ttccaacctgggtaatgtcacttcttgctcagagcatgtttttattcagacttcgagaccaaacatgacatctttgttcctcagacgagggcatgggtttagaaagaactgaactctttggctgtggtttagggtttagctaagagggcatcgctgggggttccatgctgaccgaccacacatgggcgtcgagccgtcctcctcttgtccttctcttcaccacaaggtggcactcaaaattgttgactaattatgagtagactagttggtaaatgacactcttgaagtgaagccacaggggacctgggaacct

SEQ ID NO: 333812 - DNA, 3877 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcatcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttaaag

SEQ ID NO: 333813 - DNA, 5980 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 333814 - DNA, 4893 bp, Homo sapiens
tgcttaatgtgattttgagaggagcagaaggtcgaaatctcattgatgaagattccactattacagagcagttgttgctgttattaacttagcgttaagacaacatttttcagagcacgaatcaatcatcattaatctttctcatgcaccttcttcatagatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 333815 - DNA, 5571 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgtctcccagacacccacacacatgccaaccatcctagacgaccctggaaagaaggtgaagaagccagctcctccacagcatcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 333816 - DNA, 4818 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatatgctcggggcctgggtggttacctgcgtgttggcgataac

SEQ ID NO: 333817 - DNA, 3259 bp, Homo sapiens
taaaaaaaaagaaaaaagaaaaaatatctcctctgataaataccagtggattgatccttgaagcgacagtggtgtggacagtagtgtccatcattgtatgtgcagggccgttcaaggatgctggatcaggtgtcccgggccaggccaggatctgccgtttcatcaggtcacagtagcctgcacattggcgtcaacaggcttggctcagttaggatgggaaacgcgactggttttccctctactgtctccgtggctgcgtgtggagcgtccgctaatgcgtgtggggggaagaatgttgcagggacctgcgtgcactgggtcacagctggggtggcaccttctccatgttgcaggcgggtgtctgtgcgctcctgctccccttccaatttgctcagagctgactgctgcctctcacttccaagcagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 333818 - DNA, 2354 bp, Homo sapiens
ccacagatattagaggcggcaccggttgtatttcagtgcggggactggcgtttagtttcaggttatcggcgctgggcgtacaccttcgagaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 333819 - DNA, 2929 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccaggtaagctttgggccgggatcttctgggtgccaactggttctccctgtggttgcgtgtgcttggctggtgaggagttggacgaatcgccaacctcacaggacagacaaagcattggggcagccaggaggtacaggggggcgtcactgaccaagatccccctcttctgtgttcccctgtggtaaaggagctttgggtggtgaaggcagttcggcctctgcagtcctgatgtcttagttctgtctttgttggtggtctgtctgcgacatccttgtggtgatgtggtgtgctggggactgacctgtcctgtatccctaccagccccatgacagtacttcccagtcgaagagaaaggcgaagtgaggccttggcgagaggct

SEQ ID NO: 333820 - DNA, 292 bp, Homo sapiens
tgagaggagcagaaggtcgaaatctcattgatgaagattccactattacagagcagttgttgctgttattaacttagcgttaagacaacatttttcagagcacgaatcaatcatcattaatctttctcatgcaccttcttcatagatgcaagaagaaggttccagccagcaagcgcttcaccatccacagaacatccaacgtcttaaccctttccctcaagcgctttgccaacttcagcggggggaagatcaccaaggtgagcgctcgtgacaccatcccaggcagctccgt

SEQ ID NO: 333821 - DNA, 359 bp, Homo sapiens
ctggctgcattactccatggccatcttcactctcagactagtctagtggaagatggccaggggggcagtggcctggaaactccaccaggaaacagttcagagaggcctcaagttcttcggcctcagagaagacctgaagggatgcagttgctgtttgtaaatcttaaatggctgtcttgggctcagggtgcccctgtggaaaaactcaggaaggatataaatgggtggcagatgcaagaactggctgctttgcagctagtaggcgtgtgctgcagtgtgggcgtccggaccctggtaggagtttgatctagcagcgtttgtccagtaggactttccgccatggagtaaatggcagtatc

SEQ ID NO: 333822 - DNA, 316 bp, Homo sapiens
cacctacagtggagtagcaagggcttcactctcagactagtctagtggaagatggccaggggggcagtggcctggaaactccaccaggaaacagttcagagaggcctcaagttcttcggcctcagagaagacctgaagggatgcagttgctgtttgtaaatcttaaatggctgtcttgggctcagggtgcccctgtggaaaaactcaggaaggatataaatgggtggcagatgcaagaagctgcgctaggctgtatgctaagtacgagcgatctttgtacagtcgagggcctacggaccatgttaaagcatgactg

SEQ ID NO: 333823 - DNA, 366 bp, Homo sapiens
cagcacacaccctccactctccaaccttgcccaagtgctggtccgtcacggcaccaggacagggcatggagacttgggctgattcttttctctcccttcctccctcttttttttcttctctcactcctccttttcctttcctgctgtttcctgctctcctgtttctgtcctgcagtgtctggagctccagagaggctggccctggggtggggtccacatggacatgggcgtaagcaggtttgatggtcatgggcataggcaggttcgatggccagagttctttcagctcacagtaagttttgttttgttttgttttgttttgttttgttttgttttgttttagatggagtcttgctttgtcgccca

SEQ ID NO: 333824 - DNA, 338 bp, Homo sapiens
tggggtgggggtgaggatcatagtgatttctttttaaaagctagtatgactagtgagaatggatgtccaagggcttttctcttcctcccccgagtccacgattcttcatttgtgatcagggttggggtaacttcaccttggtgatcatatattctttttacaaaccaatccagccaagatatatgtgcttttctaaacagcttgtaaaagcaaaaacacaatgtatacacatataaaactgatttttttttttttgcttatatactttgctcaggtggagaacaaggtatgaaagccattatatggtgtcccttggggaccatcccataagtccaggg

SEQ ID NO: 333825 - DNA, 923 bp, Homo sapiens
ccacgaggaacatgaccacacaggtcagcagcatcccacctatcataaagtacttgtcctggaaagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccacccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttaga

SEQ ID NO: 333826 - DNA, 437 bp, Homo sapiens
ttgatgtttgtttttttttctgttctcttctgccccaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtc

SEQ ID NO: 333827 - DNA, 672 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgggactcagaagaagatccttgacattgccaacatgctgggcttgtccaacacagtgatgcggctcatcgagaagcgggctttccaggacaagtactttatgatagagaatagcatcttgctctgttgcccaggctggagtgcaatagcacaataagagctcactgcagtctcgaactcctggtctcaagtgatcctcctgcctcagcctcccaagtagctgagactacaggagcgtgccatcacacctgtgtaattgacttat

SEQ ID NO: 333828 - DNA, 500 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacagtgagtaattaactgtggagaccagagtcctttctctgatgacagggtgctaatgggctgggcttcctgactgcactctgccttgggggcttaatgattcagcgtggaatgagttttgttgttagggtggacagaaaaaccctatggcaaagtcactgatttccctgagtgtgccctttggaatcccacaagtcttatcccccattacccctccactcaacctgacatggccctatgggaatggaagcgcttgcctccatctatcttaatctaattacctagtccttagaggaatgtactccataaaaattcagagatgtttaactggaattgg

SEQ ID NO: 333829 - DNA, 298 bp, Homo sapiens
ccacgaggaacatgaccacacaggtcagcagcatcccacctatcataaagtacttgtcctggaaagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtc

SEQ ID NO: 333830 - DNA, 3991 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagtctcgctctgtcacccaggctggagtgcagtggcgcaatcttggctcactgcatcctctgcctcctgggttcaggtgatcctcatacttcggcctcccaaagttctagggttacaggtgttagccactgtacctggcctctaaggtgattctgatgtgtgtattttggaaccactgtctcctagacagaaagcttctgtctcaaagatgatcacattggtgtaaagagcaaaacttgttaagtccaaaataaattcttactgtttatatcctaccttagtccaaaaaagatttgaggagactttgaggaaataactgaaacagatacaaagaagtgaggcacaagaacaaatcaagtcagtgtagaatgtcgacatcaggacaaggaactcaaacgttgtaacaccctaagaaatgtttggggaaccctaatttgacttt

SEQ ID NO: 333831 - DNA, 4106 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacgaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagtctcgctctgtcacccaggctggagtgcagtggcgcaatcttggctcactgcatcctctgcctcctgggttcaggtgatcctcatacctcagcctcctgagtagctggaactacaagtgtgtgccaccatgtctggctaattttttttttttttttgtattttttagtagagacagggttttactatgttgaccagattggtcttaaactcctggcctcaagtgatctgcctgcttcggcctcccaaagttctagggttacaggtgttagccactgtacctggcctctaaggtgattctgatgtgtgtattttggaaccactgtctcctagacagaaagcttctgtctcaaagatgatcacattggtgtaaagagcaaaacttgttaagtccaaaataaattcttactgtttatatcctaccttagtccaaaaaagatttgaggagactttgaggaaataactgaaacagatacaaagaagtgaggcacaagaacaaatcaagtcagtgtagaatgtcgacatcaggacaaggaactcaaacgttgtaacaccctaagaaatgtttggggaaccctaatttgacttt

SEQ ID NO: 333832 - DNA, 3897 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagaaaaaaaaaaaaaaaaagcccacctgaaagcctgtctctttccacttggttggcccttccagggggattatcgagcatgtggttttttcatagtgccttttccttattcagggttcgtcagaggggttaacaggaatcaaaatcgtggggctaaattaggttaaaggaggccaaagtttcacgcaagtggtccctacgcgggaaaaatttccctcgcgagagggagccgggacacacaaggaacacgcgacgggaaggggaggcccggtggacaaagcaggggtatagccgctagggtggagcctgggtccggacgctgccgggccgggtgtagccccgcaagatg

SEQ ID NO: 333833 - DNA, 3069 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttaga

SEQ ID NO: 333834 - DNA, 2746 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtgg

SEQ ID NO: 333835 - DNA, 4346 bp, Homo sapiens
accggaaggggggctgtgaggacgtgttccgaggaagccagacccggagccgtggcctgccgggccggcgacatggatcccctgttccagcaaacgcacaaggttcatctatattgtagcctgttaccagaatttcattctgttttatgacggaataatattccgttttatgtgtctaccacattttgttatccattcatctgttgatggacacttgagttgtttccaccattgggctgttgagaataatactgctatgaactctggtgtagaagtatctgttttagtttctcttctcaattttttgaggcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagtctcgctctgtcacccaggctggagtgcagtggcgcaatcttggctcactgcatcctctgcctcctgggttcaggtgatcctcatacctcagcctcctgagtagctggaactacaagtgtgtgccaccatgtctggctaattttttttttttttttgtattttttagtagagacagggttttactatgttgaccagattggtcttaaactcctggcctcaagtgatctgcctgcttcggcctcccaaagttctagggttacaggtgttagccactgtacctggcctctaaggtgattctgatgtgtgtattttggaaccactgtctcctagacagaaagcttctgtctcaaagatgatcacattggtgtaaagagcaaaacttgttaagtccaaaataaattcttactgtttatatcctaccttagtccaaaaaagatttgaggagactttgaggaaataactgaaacagatacaaagaagtgaggcacaagaacaaatcaagtcagtgtagaatgtcgacatcaggacaaggaactcaaacgttgtaacaccctaagaaatgtttggggaaccctaatttgacttt

SEQ ID NO: 333836 - DNA, 1810 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctga

SEQ ID NO: 333837 - DNA, 4084 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagtctcgctctgtcacccaggctggagtgcagtggcgcaatcttggctcactgcatcctctgcctcctgggttcaggtgatcctcatacctcagcctcctgagtagctggaactacaagtgtgtgccaccatgtctggctaattttttttttttttttgtattttttagtagagacagggttttactatgttgaccagattggtcttaaactcctggcctcaagtgatctgcctgcttcggcctcccaaagttctagggttacaggtgttagccactgtacctggcctctaaggtgattctgatgtgtgtattttggaaccactgtctcctagacagaaagcttctgtctcaaagatgatcacattggtgtaaagagcaaaacttgttaagtccaaaataaattcttactgtttatatcctaccttagtccaaaaaagatttgaggagactttgaggaaataactgaaacagatacaaagaagtgaggcacaagaacaaatcaagtcagtgtagaatgtcgacatcaggacaaggaactcaaacgttgtaacaccctaagaaatgtttggggaaccctaatttgacttt

SEQ ID NO: 333838 - DNA, 948 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtc

SEQ ID NO: 333839 - DNA, 2346 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagactctgatgtcagtcatgatgtttcagcctctgcccttttcctgtatcaaccctgatggataatagggcgtgggttctgtctgttatcagggtgtggtcccctgtgaatgaagcactcccagccactgagctgtgagaaacagtcactcggaagtgtgagctttatcttagtttttgttggatcatgttgagtctgtcagctccacaggacttcagtacgtttctgaacagtccctgccatctctacgggggagagggtcaggcaagctgcaagtgacactcacctcctgctgacagttgcagtgtctcagatggcctggaagggtggtctccagcagcctgctgggcgctcccctttcatgagagccacctgcagtgacctgaactgatacatgttgattagtctgccctttctttagaaaactgctactctccttttcatatctcagaaaaacagtagaggccttttaggaccaaactccatgtcacactgatgaagagccagtgggggttagagcgtcctgttaaggcacatgctagcttcccactcaagtctggcagcgctggggcatcagcacacctcttgccacccacactgataccagaggggaaggctgtgaggtggctgggggttgagacttgaggtttctaactttcctctgcacacctgtggctacctggtgtttgtctcttgattccctccacctgcctcacaccctgcctccgtcgggattttccacctacaccattcaaaaggaacataggagagggcatgaaggggctaggctgaagcactctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggcaatgaagtttgacttgtaatttctctggctgaggcttcttaattgctttctgggcagaatgtagattttggattcctgtccatgatgcctaatgttgatctcactttccttgtttctctcagttgctcattaatgtgtatttatta

SEQ ID NO: 333840 - DNA, 892 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgatagccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtgg

SEQ ID NO: 333841 - DNA, 830 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgatagctatgtgagaggccacctgagaataaagtgatccgagaagaaagcaaaacagagagagagacagagaaagagatggcaatatcagttaagtccctggattgagccatgcctgaagcctcagaacttcccaatttggagagccaatcaataaatccttttcctacttaaaaaggtt

SEQ ID NO: 333842 - DNA, 807 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtc

SEQ ID NO: 333843 - DNA, 1890 bp, Homo sapiens
accggaaggggggctgtgaggacgtgttccgaggaagccagacccggagccgtggcctgccgggccggcgacatggatcccctgttccagcaaacgcacaagtgagggccggtcggggagcgggcaggggctagacgaggcgaggccaggtgagcctggcttctggggctgaggcctcggacgtcagccagggtagaggccgagtttttccgccagggcactgctggggatgcctccgaagtgcttaatccttggcgggactcccaggtcagccacagacagtgggttcaggctggggcctggagacgtggggcagatgactcctggggtctgcaagttcgtgactacctgctgggtagactgggtgacgggaaactggcacctgcaggttataaaactttgtccagcacttgtcaactcggtgctcctggttggtagacctcgagaggagacacggagtaggagacacggcccctggccgtaggagtgtactgtttaattggagagtcaaggcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgtaagccaggcccgtggtgagggtcggcctgcacttgacagatcgtgggggctggagttcagatctctgagcgccatctgttttgggggtgtctgaagaagactgatgatgaggaaaccaactggaaatgacaggaactttgtgcattgccacagagactagacctagacagagaatccctttttctaagacaaaaacctgaagaggaagcagttaaattgaaggggaataggcagaggtgaaaattacctggttgggctggtctgagacagaaaggtggaagttcacatggtggaaacgtttttctgatcagatagagacagatgattagaacttaggccatttgtagagaaggcagcatttcaaagctgcctgcgggcagttgccattgtgccgagtatgtgtgtggctccagtgtcaggtgcattaagatgtttttgcccctagtctgagcagcaatttggaggaatttgttaacagatgtttagggttagatggactgcttgcctgagtctgtctgaaagtgtgttggtttgcatgtttgatttttcagaacccattgtccctgccctttagtcttaaccagatcatttcctgcacatggctgtagaacatactggccttttctgtgtcctgcataatatattccactaaatgaagtgtgctttggctttttgtattttgtttttttacagaggattattttctaaagagatgttagctttctaagccagttgttaaaattcacatcatttcctgctttgtagatgtttaaccctcaatgctgcatccttgctttgcaataaattttcccaagtgtttcaggctgtgccaacatagtttttgcttccccagactaagcagtcaagtcacagtgtttaacagttcaaaaatttaatgaactataagacacactaaaagatgtttggattttagatcgttataatgtagtattcaggccttttttaggccaaggatgatcgcttgggattattttgttttttgccagcctggcgtgatgctgtgcacaccgtcagttcttaataaacattgacttgccagatgaaactt

SEQ ID NO: 333844 - DNA, 1109 bp, Homo sapiens
gaaaaggaaacctctaattttctggggcccaggtacactcagagaggaaaaatggcccagggtgggagaacacacagggccctctcttcccccactctgcccgcctttcagccttgcaagaaaatctggcttttccctcggggtgtttgcctcgctgcttctcccccccagacatcacctccctcacagcccagctccatgttcacccccaccaggaagtcttcctttctaaaccgtttttctctgcatcctctcagagtggctatatttggttcctgcaatataacttcgtatatattgcatcagggagagggggagattcctgaagctgggttgttattttttgtgaagctatttttttggtgcattttctttctattccagaaaattcttatagtgggtggatgtcatttatctacccagcatctcgtctttggactacaaatccttatccccttctgctggtgccattgtctctccttcctgtggaaaacctgtgccacgggactcagcgagggctgcctcctccagcagggtcagcgcctgaagcaggcctggtccatgcaggactgggtcagcagcccaaagcagtcggtttggggtgaccacatgactgcgcggtgggccgatcagaatcttccctggaattcccatagacactgctggtttcctgaccaacatccattcctcccctattctcactagctacacgccacttttgttgatctagcaagaagtccagttgaagatatttgtgcctctagactttcttgcaggtaggggtcaggtcacccagttctggtcaataagatatgggcagaagttgctgggagagacttctgggaaagggtttcaaaaggaacatggctcctttagtccactcttaactgatggctgagatggagacatcttaacctgaaggcttttattccagctatgtgagaggccacctgagaataaagtgatccgagaagaaagcaaaacagagagagagacagagaaagagatggcaatatcagttaagtccctggattgagccatgcctgaagcctcagaacttcccaatttggagagccaatcaataaatccttttcctacttaaaaaggtt

SEQ ID NO: 333845 - DNA, 4138 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagtctcgctctgtcacccaggctggagtgcagtggcgcaatcttggctcactgcatcctctgcctcctgggttcaggtgatcctcatacctcagcctcctgagtagctggaactacaagtgtgtgccaccatgtctggctaattttttttttttttttgtattttttagtagagacagggttttactatgttgaccagattggtcttaaactcctggcctcaagtgatctgcctgcttcggcctcccaaagttctagggttacaggtgttagccactgtacctggcctctaaggtgattctgatgtgtgtattttggaaccactgtctcctagacagaaagcttctgtctcaaagatgatcacattggtgtaaagagcaaaacttgttaagtccaaaataaattcttactgtttatatcctaccttagtccaaaaaagatttgaggagactttgaggaaataactgaaacagatacaaagaagtgaggcacaagaacaaatcaagtcagtgtagaatgtcgacatcaggacaaggaactcaaacgttgtaacaccctaagaaatgtttggggaaccctaatttgacttt

SEQ ID NO: 333846 - DNA, 3312 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttaga

SEQ ID NO: 333847 - DNA, 3081 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccggtgcacagagagcacgcagagagcagagagacagagagagagagagacatcacaccgacgagaccagaactgacagcacacgcaccccagcacagcacaccccacgccaaccaccacaccccccccccacccccccaccacaccaccacccacaccccccccctctcccatctcacatctatcacctatatctacccaacccccgcactcacaccccattctccatccaccacgtactacaccacccgcttcccttaactttcaccacccacccacccccccctcccgcatcaatcgcacaccacaccacacaacaaaacggcaccccctccctcggcgatcaccatcatccaaccaaccccccaacctcgccactcgccctgccccaataccacctatcgtcatcaacacacacaaaacattcaccccct

SEQ ID NO: 333848 - DNA, 4186 bp, Homo sapiens
accggaaggggggctgtgaggacgtgttccgaggaagccagacccggagccgtggcctgccgggccggcgacatggatcccctgttccagcaaacgcacaagtgagggccggtcggggagcgggcaggggctagacgaggcgaggccaggcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagtctcgctctgtcacccaggctggagtgcagtggcgcaatcttggctcactgcatcctctgcctcctgggttcaggtgatcctcatacctcagcctcctgagtagctggaactacaagtgtgtgccaccatgtctggctaattttttttttttttttgtattttttagtagagacagggttttactatgttgaccagattggtcttaaactcctggcctcaagtgatctgcctgcttcggcctcccaaagttctagggttacaggtgttagccactgtacctggcctctaaggtgattctgatgtgtgtattttggaaccactgtctcctagacagaaagcttctgtctcaaagatgatcacattggtgtaaagagcaaaacttgttaagtccaaaataaattcttactgtttatatcctaccttagtccaaaaaagatttgaggagactttgaggaaataactgaaacagatacaaagaagtgaggcacaagaacaaatcaagtcagtgtagaatgtcgacatcaggacaaggaactcaaacgttgtaacaccctaagaaatgtttggggaaccctaatttgacttt

SEQ ID NO: 333849 - DNA, 3997 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacacagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcccacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagtctcgctctgtcacccaggctggagtgcagtggcgcaatcttggctcactgcatcctctgcctcctgggttcaggtgatcctcatacctcagcctcctgagtagctggaactacaagtgtgtgccaccatgtctggctaattttttttttttttttgtattttttagtagagacagggttttactatgttgaccagattggtcttaaactcctggcctcaagtgatctgcctgcttcggcctcccaaagttctagggttacaggtgttagccactgtacctggcctctaaggtgattctgatgtgtgtattttggaaccactgtctcctagacagaaagcttctgtctcaaagatgatcacattggtgtaaagagcaaaacttgttaagtccaaaataaattcttactgtttatatcctaccttagtccaaaaaagatttgaggagactttgaggaaataactgaaacagatacaaagaagtgaggcacaagaacaaatcaagtcagtgtagaatgtcgacatcaggacaaggaactcaaacgttgtaacaccctaagaaatgtttggggaaccctaatttgacttt

SEQ ID NO: 333850 - DNA, 1198 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaaaaaaaaaaaaaaaaaaaaaaaaccgggggacttctttgtggggtgggaacacaaaagcggataagaacacgcgcacagagggcccacagggtggcgcacgacaaacacagacgagagagaggcagaccacagcgggaggagaaaaaaccccgaccagaggagaaacccagaaaaatagagggagcacgcagcagagaaaaaattaccgaaacacccgccgcggagcaaaagcagccgcgaataagaagcagacagcggcaaaacaaagcacgcgagacacacaacacaaccaagaaacagcaaccacgcgacaccgagacacagctcgccccaacc

SEQ ID NO: 333851 - DNA, 2201 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagactctgatgtcagtcatgatgtttcagcctctgcccttttcctgtatcaaccctgatggataatagggcgtgggttctgtctgttatcagggtgtggtcccctgtgaatgaagcactcccagccactgagctgtgagaaacagtcactcggaagtgtgagctttatcttagtttttgttggatcatgttgagtctgtcagctccacaggacttcagtacgtttctgaacagtccctgccatctctacgggggagagggtcaggcaagctgcaagtgacactcacctcctgctgacagttgcagtgtctcagatggcctggaagggtggtctccagcagcctgctgggcgctcccctttcatgagagccacctgcagtgacctgaactgatacatgttgattagtctgccctttctttagaaaactgctactctccttttcatatctcagaaaaacagtagaggccttttaggaccaaactccatgtcacactgatgaagagccagtgggggttagagcgtcctgttaaggcacatgctagcttcccactcaagtctggcagcgctggggcatcagcacacctcttgccacccacactgataccagaggggaaggctgtgaggtggctgggggttgagacttgaggtttctaactttcctctgcacacctgtggctacctggtgtttgtctcttgattccctccacctgcctcacaccctgcctccgtcgggattttccacctacaccattcaaaaggaacataggagagggcatgaaggggctaggctgaagcactctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggca

SEQ ID NO: 333852 - DNA, 1409 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagacttctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggca

SEQ ID NO: 333853 - DNA, 1479 bp, Homo sapiens
accggaaggggggctgtgaggacgtgttccgaggaagccagacccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgtaagccaggcccgtggtgagggtcggcctgcacttgacagatcgtgggggctggagttcagatctctgagcgccatctgttttgggggtgtctgaagaagactgatgatgaggaaaccaactggaaatgacaggaactttgtgcattgccacagagactagacctagacagagaatccctttttctaagacaaaaacctgaagaggaagcagttaaattgaaggggaataggcagaggtgaaaattacctggttgggctggtctgagacagaaaggtggaagttcacatggtggaaacgtttttctgatcagatagagacagatgattagaacttaggccatttgtagagaaggcagcatttcaaagctgcctgcgggcagttgccattgtgccgagtatgtgtgtggctccagtgtcaggtgcattaagatgtttttgcccctagtctgagcagcaatttggaggaatttgttaacagatgtttagggttagatggactgcttgcctgagtctgtctgaaagtgtgttggtttgcatgtttgatttttcagaacccattgtccctgccctttagtcttaaccagatcatttcctgcacatggctgtagaacatactggccttttctgtgtcctgcataatatattccactaaatgaagtgtgctttggctttttgtattttgtttttttacagaggattattttctaaagagatgttagctttctaagccagttgttaaaattcacatcatttcctgctttgtagatgtttaaccctcaatgctgcatccttgctttgcaataaattttcccaagtgtttcaggctgtgccaacatagtttttgcttccccagactaagcagtcaagtcacagtgtttaacagttcaaaaatttaatgaactataagacacactaaaagatgtttggattttagatcgttataatgtagtattcaggccttttttaggccaaggatgatcgcttgggattattttgttttttgccagcctggcgtgatgctgtgcacaccgtcagttcttaataaacattgacttgccagatgaaactt

SEQ ID NO: 333854 - DNA, 699 bp, Homo sapiens
accggaaggggggctgtgaggacgtgttccgaggaagccagacccggagccgtggcctgccgggccggcgacatggatcccctgttccagcaaacgcacaagttataaaactttgtccagcacttgtcaactcggtgctcctggttggtagacctcgagaggagacacggagtaggagacacggcccctggccgtaggagtgtactgtttaattggagagtcaaggcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgggactcagaagaagatccttgacattgccaacatgctgggcttgtccaacacagtgatgcggctcatcgagaagcgggctttccaggacaagtactttatgatagacaaagaacatatgttcttgacaagggagtgtgccttgttccccacccacagtcaccactg

SEQ ID NO: 333855 - DNA, 411 bp, Homo sapiens
tgcaggtgtcgaagtgccaaaataaccttcacactcctcatagccacgatgaccaaatccaaattcagagtgatcatgctgttacaatataacctcaattcatatccatcatgctgttacaatagaaccttggttcatatccatcatgctgttacaatagaacctaaacattcacaaagcagatatttgaggttacattggtgacggtgacgtcacgactcagctttcattctctatattttccagtgtagactgaagatacatgtcttagggtctcaccaagattcaggagtgaaggatccagtggtgaggacccaggtattcaaggcgcttcacctggaggcctggcctttcccaaggtgtatcagtagcctcaggccctgacataacactaacactagtgatgccttg

SEQ ID NO: 333856 - DNA, 289 bp, Homo sapiens
catcatctatcaccacaggccctgtacccccaccctctctacaaccctgctgggaggctgtcctcatttactctccatcctgtcttccccttcctccaacctgtcaataagccctgtccaaattctccttcaaatagattctctcctccacatgttcctctactgacttgaacttaggtccttatcaactctattggtttcctattccctgctattgaaacttctaaactataagcttccaactattacctgcctgaatgtaaatattaaatggagatgttgaaggtgc

SEQ ID NO: 333857 - DNA, 101 bp, Homo sapiens
aaaatcctcaggtaaaatacacattgtcttcagctcacttttgcttttagagctatgaatcctcttttaagataaacagacaatacccacccatccccagt

SEQ ID NO: 333858 - DNA, 299 bp, Homo sapiens
atggattttatctacgtagtaaatttgaattattttaattcaaatgtgggaaactcaattcaaacttgaagaaaagctggatttattgggttacataactgaaaaatactggagtctaatagtctgtggctcatccgaatctgggaacttacataatatttggagttggtttcctcttttgtattggcttcattttccaacacgttcttttcagagtggtgagatgcttccttactattcattccaagcttacatcttattattaaaaacatgggtcagtaacctttttctgtaatggg

SEQ ID NO: 333859 - DNA, 229 bp, Homo sapiens
tgctgtcaggcagaatgtccccccaggtcagtgaggtcaggctggttgagtgttcaggctttctattctgatttttgttgttgttgtttacttgttccaccaatcaatgagaaagatgtccatgtctctcactatatttgtggatttgtccatttcttccttcagtcctggcaggtttcgcttctgaattttctcttttttttttttttttttttgagacagagtctcg

SEQ ID NO: 333860 - DNA, 217 bp, Homo sapiens
agtgtttgacaatgcagatacttgcctgtttttctaaataaagggaacatcaaaaactagcagaggatagaggaaacttgggatccctctgccctgtgaaggaggagggaggatggtgtatccatgtgaaagaaagtgccagaatgtcaggggtcccagccattgtctgtacaatataggcccctttctccccccaggagattagcagtgcagagtt

SEQ ID NO: 333861 - DNA, 270 bp, Homo sapiens
tagagacgggttttctccatgttggtcaggctggtctcgaactcccgacctcaggtgatccgcccacctcggcctcccagagtgctggaattacaggcttgagccactgtgcctggccgagttttggaaatttagttcaatagtgtgaactcaaagttattagaaacccgtacttgtcagacttcattctttccatgaagctccttgaagacataattctctgggattataattgcctgcaagaagctttcagaaagacattagactaaa

SEQ ID NO: 333862 - DNA, 371 bp, Homo sapiens
gcgctggtaaaactatgtttcatcacctgttacaattctttgaagaaatgcttcaggatcttgatcccacccgtttaaaatttccattagaaactctgctcttgtctgcagctgatctgagggcaatggttttggcacccatctagtaaaacgtttgctcagtgttaatttttcatccaggattgtgtaagctgaaccagcagagatgtctatgatattggctagttggtcctcttcaatgagggcatgaacaagatgaatattttcctcaaacaattatctggatggtctgctgctgcaggcttcatcttcaatattgtctcgtcccttctttttcttttcccccccgcttgagacacagtcttgttctg

SEQ ID NO: 333863 - DNA, 90 bp, Homo sapiens
catggctttatccctataaatatttattgataagaacaggtggctggctggatttaagtctgttggccatagtttgtcaattcagtcaca

SEQ ID NO: 333864 - DNA, 510 bp, Homo sapiens
ttctacatcagcactgtccaatagaaatataatgcaagccacatgtagttttacattttctagtaacctcatttaaaatgcaaaaagaaattattaaaccaattttaatattttatttagcccagtatataaaaatattatcatttcaacatggaattaatattaaacagttattaatgaattatgtcacattctgtttttcatactaagtcttcaaaattcagtgtgtattcaacacttagcacatctcaagttggactactcatgtttcaagtggtcagtagccatgtgtgactagtggctatcatattaaagtgtagctctagatcataggtcattattatagtctgtaaaaatttcaaagtagttccagatcatagagcattattgtagtctgtaaaaatttcaagaaaggagataaaaatagggatgaaactaccaagacgtcaaatatttatgtcgtttggggagaaaacttttctgggaagaactatgaatgccctcacccat

SEQ ID NO: 333865 - DNA, 1336 bp, Homo sapiens
gccaaaaggcaggccaagagcaggagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactc

SEQ ID NO: 333866 - DNA, 1770 bp, Homo sapiens
gccaaaaggcaggccaagagcaggagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaagaaaaaaaaaaaaacaaaaaaaaaaaaagaacagaaacgagaaagaccaacaaagaaactcaacgacaagcaaaagcaacaaacgaaaagaacagaacacacaaaagagaagaccaaaaagaaaacacaaaaaaaaaaaaagaaaaaaaaaaaaagagaaaaaacaaacaaaacaaaacaaacgagaaaataaaaaaacaacgaaaaaaaaaataaaagaaaaaaacaaccaaaagcagagaagaaaaaacagagaaacacacaaaaaaaacaaaacaaaacagagacaaaacaaaaaaaaaaaaagaaagaa

SEQ ID NO: 333867 - DNA, 1983 bp, Homo sapiens
gccaaaaggcaggccaagagcaggagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgtgtgtgtgcgcgcgcgcgagatgagagagagagagagagagaaagtgtgtgtggtgtgagatgagcgctgatgcttctcatcaagagagctcccgtgagacacatcaaaaacaaaacaacaaaaaaaaacagagaaaagaagagaaaaaaaacacaacacgacaagcagaacacagagaggaaagaaacgagaaaaaagaacagaagcaaaaggcaacgaagcggcaggcggcggcgcacagaacgagaccaagacagagagagcgaagacaaccccagaagacgcaagaccgagccgcggaacgcagcggacaaacgcgagcaaaagaaaaagaatagacaagaaaacgcagacacaaaccgaaacgcggagcagcgaacagaaacctgaccaccgagcgacacgggcagcgagaggaggagaaagcaggacgacgacagcacgccacggacgcacgcgcgcagcagaagaagcgaagcgaacggagaaggcgaggcggggcgggcacagaagacggacgacgagggagcgagacccaccgccacacaagaacaagcacaccgaaagagagaacaagagagatgcgaacgagaggcgccaagagacccacgacgcgagagaaaacatacaaggaccacaacaacccggcacaagaaacccacaaaccgatcaagaaagacgagaacggggcagacgaacagaagacagcgaaagaagaaacgaacaacaaaaagagc

SEQ ID NO: 333868 - DNA, 1240 bp, Homo sapiens
gccaaaaggcaggccaagagcaggagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactc

SEQ ID NO: 333869 - DNA, 1407 bp, Homo sapiens
ccaggcagcagttagcccgccgcccgcctgtgtgtccccagagccatggagagagccagtctgatccagaaggccaagctggcagagcaggccgaacgctatgaggacatggcagccttcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactc

SEQ ID NO: 333870 - DNA, 1161 bp, Homo sapiens
gccaaaaggcaggccaagagcaggagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactc

SEQ ID NO: 333871 - DNA, 989 bp, Homo sapiens
gggctggcgggctgggggcgggccgggctgggaaaatcagcggttggacttggcacacgctccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactc

SEQ ID NO: 333872 - DNA, 1990 bp, Homo sapiens
cgcaaggcaagcagcagcccctgtaagcacacgagacaatcccaagtgtcagtgggaaggagatccctttcctgatggggctgcctgtgtccagtccctcccagcttccccagggccctggggctctgcaggcattcagaagtggaagccagccacagcctgggactgaagaggttaatgtgcatctgcctccgaatgttaatgtgtctaggtgatgtcagtgggagccatgaagaagggagtggggagggcagttgggcttggaggcggcagcggctgccaggctacggaggaagacccccttcccgactgcggggcttgcgctccgggacaaggtggcaggcgctggaggctgccgcagcctgcgtgggtggaggggagctcagctcggttgtgggagcaggcgaccggcactggctggatggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcacacgttgctggggaggcctggagtcaggtttggggttttcagatatcagaaatccccttgggggagcaggatgagacctttggatagaacagaagctgagcaagagaacatgttggtttggataaccggttgcactatatctgtgagctctcaaatgtcttcttcccaaggcaagaggtggaagggtactgactgggtttgtttaaagtcaggcagggctggagtgagcagccagggccatgttgcacaaggcctgagagacgggaaagggcccgatcgctctttcccgcctctcactggtgcgatggaaggtggcctttctcccaagctggtggataatgaaaaataaagca

SEQ ID NO: 333873 - DNA, 2104 bp, Homo sapiens
atgttgtgtccttccaagacagatggctcagggcactctggtaggattcaccaggaaactcatggagaagggaaaagggacaagattagcaacagtgaagggagggagaatggtgggagaggattccagatgaacggtgggtcgctggaggctgagcatgccagcaggatgtcagttctcagagcaaagcccatgtcaaacagccaacgcttgctccttctgtccccaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcacacgttgctggggaggcctggagtcaggtttggggttttcagatatcagaaatccccttgggggagcaggatgagacctttggatagaacagaagctgagcaagagaacatgttggtttggataaccggttgcactatatctgtgagctctcaaatgtcttcttcccaaggcaagaggtggaagggtactgactgggtttgtttaaagtcaggcagggctggagtgagcagccagggccatgttgcacaaggcctgagagacgggaaagggcccgatcgctctttcccgcctctcactggtgcgatggaaggtggcctttctcccaagctggtggataatgaaaaataaagcatcccatctctcggcgttccagcatcctgtcaatttcccttttgctctagaggatgcatgtttatttgaggggatgtggcactgagcccacaggagtaaaagcccagtttgctaggaggtctgcttactgaaaacaaggagacctggggtgggtgtggttgggggtcttaaaactaataaaagctggggtcggggggcttttgcagctctggtgacattctctccacggggcacatttgctcagtcactaatccagcttgagtgtccgtgtgttctgcatgtgcaggggtcattctagtgcccggtgtgttggcatcatctttttgctctagcccttcctctccaaaataaaatcaaataaaggaaaatctccacccacaaactctgga

SEQ ID NO: 333874 - DNA, 2378 bp, Homo sapiens
cgcaaggcaagcagcagcccctgtaagcacacgagacaatcccaagtgtcagtgggaaggagatccctttcctgatggggctgcctgtgtccagtccctcccagcttccccagggccctggggctctgcaggcattcagaagtggaagccagccacagcctgggactgaagaggttaatgtgcatctgcctccgaatgttaatgtgtctaggtgatgtcagtgggagccatgaagaagggagtggggagggcagttgggcttggaggcggcagcggctgccaggctacggaggaagacccccttcccgactgcggggcttgcgctccgggacaaggtggcaggcgctggaggctgccgcagcctgcgtgggtggaggggagctcagctcggttgtgggagcaggcgaccggcactggctggatggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcacacgttgctggggaggcctggagtcaggtttggggttttcagatatcagaaatccccttgggggagcaggatgagacctttggatagaacagaagctgagcaagagaacatgttggtttggataaccggttgcactatatctgtgagctctcaaatgtcttcttcccaaggcaagaggtggaagggtactgactgggtttgtttaaagtcaggcagggctggagtgagcagccagggccatgttgcacaaggcctgagagacgggaaagggcccgatcgctctttcccgcctctcactggtgcgatggaaggtggcctttctcccaagctggtggataatgaaaaataaagcatcccatctctcggcgttccagcatcctgtcaatttcccttttgctctagaggatgcatgtttatttgaggggatgtggcactgagcccacaggagtaaaagcccagtttgctaggaggtctgcttactgaaaacaaggagacctggggtgggtgtggttgggggtcttaaaactaataaaagctggggtcggggggcttttgcagctctggtgacattctctccacggggcacatttgctcagtcactaatccagcttgagtgtccgtgtgttctgcatgtgcaggggtcattctagtgcccggtgtgttggcatcatctttttgctctagcccttcctctccaaaataaaatcaaataaaggaaaatctccacccacaaactctgga

SEQ ID NO: 333875 - DNA, 532 bp, Homo sapiens
gtcaatatgttaccatttgctaaattagttccactttcctctaagctcaagatttggtctatcttggtggaattatattcccacagaggtgcatgcacaaagttcactcctacatgcccattacttcctgccgtccacccttgcccttcctttcctggccttgactcacatgatacattgatctggatgcaaataccagcctattgactttgtaaaagtgaacaccccaatttccccgtgagcccctcccctccaacactactctccctgagtaagtgaagaccttgttcatccactggacaaaattataggaggccgcttaaatcagtgtgtgcaggacatcatgactcagcacatgatccatgagggatggcttcagaaccactgtcagcagcgcagctcagcgcttgtgtcccagctcagtccttgtatcccccttgatgtacttctttctgttctcctcatattttctgtgtctggtcatttcctgtcctgcctgcgctgactattgtgcctaagaacatgtcgtggg

SEQ ID NO: 333876 - DNA, 324 bp, Homo sapiens
ttcattttagtttttgctttgtgtttgggttttatgtaaccagaagaagaaaattcttgatggaatcacagaaaacttgagagttaattatagttcagtgtagtgaatgctttgatcctgaaggctgtgaaactgaatcgttttcattcagaaaatttctcatgtcaggtttttcaaacaaaaagaatgattagtaaactattctattacctttcattcccatagctctcctgtaatttgtaagactcaaatgatacacactgaaccttgggctgagatttaattttgtatatttgccaaagtacacagtagcctagtttccat

SEQ ID NO: 333877 - DNA, 658 bp, Homo sapiens
ttatcgattcatatctttgctcggtttttatggggttgcaagatctttttgttatcaagtttccaagtacttactgcatgtatatcaggaaggctaccctctgtctatgattaaaattaccaataagttttgctaattcctaactgtaaataagttttggctgcaaataagttttaccagttttgctgaaactctatatccactgaacaattccctttttccccttcccctagctaccaccactctactttgtttctaagggtttgactactttagatatctcatataagtggggtcatgcagtatttgcctttttgtgactggctttcacttagtgtaattcctcaaggttcatctacggttgtatcacacaacaaaatttcctttttaaagtttgaataatatttcattgtatgtatatacattttctttatccattcagagaaggttttttttttttggaaacggggtctcactctgtcacccaggttggagtgtagtggtgcaatctcggtttactgcagcctccaccttccaggctcgagagattctcccaccacagcctcccgagttgctgggaccacaggcacatgccatcatgtccagctaatttttttgtatttttggtagagtcagggttttgtcatgctgccaggct

SEQ ID NO: 333878 - DNA, 2191 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcggaggttgcagtgagctgagatcgtgccactgcactccagcctgagtgacaggagttaagccctgtctcagaaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaacatttgccaatgacagttaggcgtgcacactgaccattcactgataaaccagattctgcctgaatctgaagggattgcttgtagcatagggtttagtggcgtgatctcggctcactgcaagctccgcttcccgggttcatgccattctcctgcctcagcctcccgagtagctgggactgcaggcaccgccaccacgcctggctaattttttgtatttttagtagagaaggtgtttcaccgtgttggccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcct

SEQ ID NO: 333879 - DNA, 769 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagtgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333880 - DNA, 658 bp, Homo sapiens
gatcattagataattcagagaaacagtaatcagtttatgatgtttcagcacattataaacagaaatcagtttataaggattccagggaataaccaaaagttctttgaaactgttaaccagaacagtaatgataataatcagcagattctctcaggagaagttctttgccagtgatattgttcttgtactttataacattatcatgttttttgagacggagtcttgccctgtcgcccagactggagtgtagtggcgtgatcttggctcactgcaacctccacctcccaggttcacgccattctcctgcctcagcctcccgagtagctgggactgcaggcaccgccaccacgcctggctaattttttgtatttttagtagagaaggtgtttcaccgtgttggccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcct

SEQ ID NO: 333881 - DNA, 1031 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccaggtttgtcaccgtttctctccggccggtcagggcaagagccagagtgtaccatggcttccagtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtcgtcagtcagtcagtcagtcagtcagtcagtc

SEQ ID NO: 333882 - DNA, 387 bp, Homo sapiens
gatcattagataattcagagaaacagtaatcagtttatgatgtttcagcacattataaacagaaatcagtttataaggattccagggaataaccaaaagttctttgaaactgttaaccagaacagtaatgataataatcagcagattctctcaggagaagttctttgccagtgatattgttcttgtactttataacattatcatgttttttgagacggagtcttgccctgtcgcccagactggagtgtagtggcgtgatcttggctcactgcaacctccacctcccaggagaattgcttgaacccaggaggcggagtttgcagtgagccgagatcgcaccactgcactccagcctgggcgacacagtaagactctgtctcaaacaat

SEQ ID NO: 333883 - DNA, 2398 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccaggtttgtcaccgtttctctccggccggtcagggcaagagccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagagctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcggaggttgcagtgagctgagatcgtgccactgcactccagcctgagtgacaggagttaagccctgtctcagaaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctggaatgtagtggcgtgatctcggctcactgcaagctccgcttcccgggttcatgccattctcctgcctcagcctcccgagtagctgggactgcaggcaccgccaccacgcctggctaattttttgtatttttagtagagaaggtgtttcaccgtgttggccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333884 - DNA, 2509 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgagaacaatgaaaagcagcagttaagggaacacaggaatgaagcaaaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcggaggttgcagtgagctgagatcgtgccactgcactccagcctgagtgacaggagttaagccctgtctcagaaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctggaatgtagtggcgtgatctcggctcactgcaagctccgcttcccgggttcatgccattctcctgcctcagcctcccgagtagctgggactgcaggcaccgccaccacgcctggctaattttttgtatttttagtagagaaggtgtttcaccgtgttggccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333885 - DNA, 2551 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccaggtttgtcaccgtttctctccggccggtcagggcaagagccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgagaacaatgaaaagcagcagttaagggaacacaggaatgaagcaaaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcggaggttgcagtgagctgagatcgtgccactgcactccagcctgagtgacaggagttaagccctgtctcagaaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctggaatgtagtggcgtgatctcggctcactgcaagctccgcttcccgggttcatgccattctcctgcctcagcctcccgagtagctgggactgcaggcaccgccaccacgcctggctaattttttgtatttttagtagagaaggtgtttcaccgtgttggccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333886 - DNA, 2324 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagacctgtgcaacagacctgcagaccaaagctgaccgattggcacagatgagcatatgttcttcattggcccggaaattccccaaactcacaattataggggaagagctcgtggtctgggttgatcctctggatggaaccaaggaatataccgaaggtcttcttgacaatgtaacagttcttattggaattgcttatgaaggaaaagccatagcaggagttattaaccagccatattacaactatgagctatgctattaactgatgagaaacctttaaaaatacggattcccaggccataccccagacctactgaatcaaaatcgctgggggcattggtactgggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcggaggttgcagtgagctgagatcgtgccactgcactccagcctgagtgacaggagttaagccctgtctcagaaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctggaatgtagtggcgtgatctcggctcactgcaagctccgcttcccgggttcatgccattctcctgcctcagcctcccgagtagctgggactgcaggcaccgccaccacgcctggctaattttttgtatttttagtagagaaggtgtttcaccgtgttggccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333887 - DNA, 1564 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttgtgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333888 - DNA, 1491 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgagaacaatgaaaagcagcagttaagggaacacaggaatgaagcaaaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggattgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333889 - DNA, 1056 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagcctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333890 - DNA, 435 bp, Homo sapiens
acgagggacctgggtctacgataacgcgcttttgctcctcctgaagtgtctttggtccaacgttgttccaggtttgtcaccgtttctctccggccggtcagggcaagagccaggtagataggatttatgttaaaaaaataaaacgaaaaaggtttatgtgaatcagattgcttctccagatattctaacttccgacttggactcttgagtgtcgatattttaattgtttatctgtgcttttattttcgtgatccggaaggtttttatagccatatactgtagaaacaagacaaacctagacattgagtttgttgatgcacccaaatttagaaactgcttggtacctaaaattaaatttctttaaacagcaaatattcttccaactgccatttctacatatttataggtttgcgtgatttatttggatttctctgt

SEQ ID NO: 333891 - DNA, 1037 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccaggatgtcctcgtacacaggtggaagcattgactgagggtctggccatggaatccatctgtttccaggataaacttcatcctaaatattaggttattgtgaagcgctggcagtctatttcgcaaaaaaaaaatggggcgataaaggcgggagagagataaccatgtaccgcaggaacactccacacttaaaaaaag

SEQ ID NO: 333892 - DNA, 2464 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcggaggttgcagtgagctgagatcgtgccactgcactccagcctgagtgacaggagttaagccctgtctcagaaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctggaatgtagtggcgtgatctcggctcactgcaagctccgcttcccgggttcatgccattctcctgcctcagcctcccgagtagctgggactgcaggcaccgccaccacgcctggctaattttttgtatttttagtagagaaggtgtttcaccgtgttggccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333893 - DNA, 2216 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcggaggttgcagtgagctgagatcgtgccactgcactccagcctgagtgacaggagttaagccctgtctcagaaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctggaatgtagtggcgtgatctcggctcactgcaagctccgcttcccgggttcatgccattctcctgcctcagcctcccgagtagctgggactgcaggcaccgccaccacgcctggctaattttttgtatttttagtagagaaggtgtttcaccgtgttggccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcct

SEQ ID NO: 333894 - DNA, 2266 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcggaggttgcagtgagctgagatcgtgccactgcactccagcctgagtgacaggagttaagccctgtctcagaaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctggaatgtagtggcgtgatctcggctcactgcaagctccgcttcccgggttcatgccattctcctgcctcagcctcccgagtagctgggactgcaggcaccgccaccacgcctggctaattttttgtatttttagtagagaaggtgtttcaccgtgttggccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333895 - DNA, 2308 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccaggtttgtcaccgtttctctccggccggtcagggcaagagccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcggaggttgcagtgagctgagatcgtgccactgcactccagcctgagtgacaggagttaagccctgtctcagaaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctggaatgtagtggcgtgatctcggctcactgcaagctccgcttcccgggttcatgccattctcctgcctcagcctcccgagtagctgggactgcaggcaccgccaccacgcctggctaattttttgtatttttagtagagaaggtgtttcaccgtgttggccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaaa

SEQ ID NO: 333896 - DNA, 1165 bp, Homo sapiens
tgcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccaggatgtcctcgtacacaggtggaagcattgactgagggtctggccatggaatccatctgtttccaggataaacttcatcctaaatattaggttattgtgaagcgctggcagtctatttcgcaaaaaaaaaatggggcgataaaggcgggagagagataaccatgtaccgcaggaacactccacacttaaaaaaag

SEQ ID NO: 333897 - DNA, 811 bp, Homo sapiens
tcattccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagattgtcccgctattacaattcctctagaaaatactctcagaagaaaggcacgatggctcacacctgtaatccaagcactttgggaagctgaggtgggaggattgcttgaggccagaagttagagaccagcctgggcaacacagcaacatcccatctctacaaattaaaaataattttgtttttttaaaaaaatgaaaatactctttgatatggtttggctatgtccccacccaaacctcatcttgaattatagttcccataatccccacttgtcatgggagggagcaggtggagatagttgaatcatgggggtggtttcccccatccagttctcatgatatgagttagttctcgcaagatctgatagttttagaaggggcttccccctctgctggactctcattctctctctcctgccaccctgtgaagaggtgccttctgccataattgtaagttatctgagacctcccc

SEQ ID NO: 333898 - DNA, 703 bp, Homo sapiens
tcattccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataaggtaagtaacattttggtttactcactggattgtggtagccttaaattaatgtggcagtttaggtatatgattgttccttagaaaaatgccttctcacggggtattgaaggttgcatttgagattctaatacagataatttttaatttacagtataacctacttgtgagatacatagtgtaatacattgatattccttttatgatcattttttatgaaaaatatagtgcctgagaaatggaaacattgtggtagctttatattggtttgttttttttgttttgttttgttttcttgaaggatttagtagttaccaggttcttagtttcttatatttcttttgctaccctctgatctcagttaaaggtgaaacatatatcagatttatatgattatctttgaataattatagctcaatcattatatttttcaattgaaataaaaagtagtcttagtaattattagaaaatttaaagtggaaaa

SEQ ID NO: 333899 - DNA, 1731 bp, Homo sapiens
tcattccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatataatcgatgtgtcactggcctaaaccgttgaaatttgcaataaattatggagtgtcagctgacttggggaaatgaaaccttcaaacaataattaccactccaaatgggaagcagaggatcagagccgaagcacctgaagacaatatgtctgtggaatgaggctaccaatgtgaaaggattctcagacataaggactgattatattcgtcttagtcaaaatagaacttgatttaaattgcctctgaaaattaaagcacggaaacctttttttgataaaactattccccatcattagggtcgaagacttacctgatttacaacattgtgtaagctctgagataagaaactttccaaacttgctgttactgtaggaacacaacgtgcccacaaa

SEQ ID NO: 333900 - DNA, 1812 bp, Homo sapiens
  misc_feature (1812)..(1812): n is a, c, g, or t
tcattccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtggaccattttgtgtggccaccggaacacgaagacggaaacccatcggtcacaaaatcaatcgaagggaaaaagtctcaggctacattgaaggaatctcctcacaccctggaagcgggacgacaaccacagcacaaaggcaccaaactgctgcatcagcgcagcaccacaacatcaggggcacatcacaggggatacaacaccaggaaaacaagacaacgagcacaagggcactcaacaaaagaacacaggacgagacacgacagacaccgacacgcagacgaaccactccatacaccacacaaggcgacgcaaccaaagacacacccgccgtcccgcgcccccccctcaccccgtccccacaccccgcn

SEQ ID NO: 333901 - DNA, 1357 bp, Homo sapiens
attttttatatttcgtgttttccagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatataatcgatgtgtcactggcctaaaccgttgaaatttgcaataaattatggagtgtcagctgacttggggaaatgaaaccttcaaacaataattaccactccaaatgggaagcagaggatcagagccgaagcacctgaagacaatatgtctgtggaatgaggctaccaatgtgaaaggattctcagacataaggactgattatattcgtcttagtcaaaatagaacttgatttaaattgcctctgaaaattaaagcacggaaacctttttttgataaaactattccccatcattagggtcgaagacttacctgatttacaacattgtgtaagctctgagataagaaactttccaaacttgctgttactgtaggaacacaacgtgcccacaaa

SEQ ID NO: 333902 - DNA, 1674 bp, Homo sapiens
  misc_feature (1674)..(1674): n is a, c, g, or t
tcattccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaagtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtggaccattttgtgtggccaccggaacacgaagacggaaacccatcggtcacaaaatcaatcgaagggaaaaagtctcaggctacattgaaggaatctcctcacaccctggaagcgggacgacaaccacagcacaaaggcaccaaactgctgcatcagcgcagcaccacaacatcaggggcacatcacaggggatacaacaccaggaaaacaagacaacgagcacaagggcactcaacaaaagaacacaggacgagacacgacagacaccgacacgcagacgaaccactccatacaccacacaaggcgacgcaaccaaagacacacccgccgtcccgcgcccccccctcaccccgtccccacaccccgcn

SEQ ID NO: 333903 - DNA, 176 bp, Homo sapiens
ctcactgggagctgggctgtctgccttgcactgctgaatttctgtccctcagcctggcacttggcacacagtaggtcttccctaggggtttgctcaaagatttaatgaattcatggaacctctccccttcctgcttcttcacctgaccagctcggacccttcctttcgttttcagc

SEQ ID NO: 333904 - DNA, 469 bp, Homo sapiens
gagatggaatctattcctggtgaagatgctgtgaaagttgttgaaatgacaacaaaggattgagaatattctgtaagcttcactgataaaggaactagcagggttggagatggtaaaatgctatcaagcagcatcacatgctacagagaaatattttgtgaaaggaagacttaatgcatcaaacttcattgttgtcttattttaggaaattgtcacagacaccccaacctttaccaaccaccaccccagtgagtcagcagccactaacatgaatgcaagaccctctaccaatagaaagattatgacttgttgaaagactcagatggttattaatacgttttagcggtaaagtatttttaaattatgtacattgttttttggacataatgctatcacacacttaataaactaagctacaatgtaaacttagttttaaacatttttttaaattattattatttttttgaga

SEQ ID NO: 333905 - DNA, 641 bp, Homo sapiens
tggtgtcagcaaggtccctgccctgagtgtcactgcccctgggcagctgacctggcccacgccacttcctcccacaccactgcctccttaccctgctttatgaagttttcttggcccttctcagtgccctaaatgaaatattcatgacttagttggcatctccgtggcaacctggccttgtgcccttgtgccctaggatgttccagctcctcacaaatactggcacagaggggacattccttgaacagtgaatgccactggacagcctcgaagtcagcgaggatgctgggaggccatcccagaggggatccgatgggaccttggtctaggggcccttgaagggtcttcaccaacctcagcttctacgactgtaaaagcaactcaaacagaactgtactgtgcatgcctggaggtccccaaacctcccgttaaaatgaccaacacatgggaggacagctcttgtggctgccccaaagagacggagacatcctcaatatgaaaaccacgtgccccactctgctcccacatggcgtgcaacatgccccacaccacccagagcagggagggaccctggctgactctggagaggctgctctgaggcccaagtcaacaagaggctatggctgtgcagaaggaacagc

SEQ ID NO: 333906 - DNA, 872 bp, Homo sapiens
tgttatcctaaggtggaatatctcaaacgcaaaatcaaataccacatgatctcacctataagtgaagctaaacaatgggtacacataaacataaagacagaaataataggtactgaaaagtacctataagggttgaaaaattacctattgggtacaatgctcactattgtagatgggtacactagaagctcaaatctcaccattacataatatatccatgtaataaacatgcacatgtacccccaaatataaaataatactaaaaataagtgaacaaaaccattttcattgaaaaataagagggcttaaacaagttctagaagttgaataaagtcaacttaaaaggtaagaaaagagtacgaagaaaaaaaaataatccattcaaaaggttttataatagaaggaggagggagataatcaggggataaaacacaccttagtttacatgtcgtatcttgagatgttaacctcataaccatgtgccaaatctgaatcatcactcagctggtaacatcatcatatggtaatggcaggtcagtgccgttcaaaatatttaataatgtttgaccacattccagataccttaagattccaatttaaaactgctgaccacaaaaaaaaaaaaaagaaagacaagcagagaaacacactgagccctagagcaccactgcctcctaggaagggaactcaagggagactccagagtttggtcacgtctccagtctgccactgactagctgttttgactccctctgagcaccagatttctcagctttaaaaatgcaggattaaattagttgttatccttaggtgtaccttcctatttttaaattacacatggtaacctaaggatacacgtccgcgagggtccg

SEQ ID NO: 333907 - DNA, 289 bp, Homo sapiens
cctgtaacctattgtttttttcctctggaagttttcaggttttttgtcttgtcctcagcgttttgaaatttcagcaatgtgccttggtatgggtctcttttttccattgtggctttttgtctggaaactcactggccatcaattctgaaaatttaccttctactcatttcatttcttgccctctgttttttatgttgccccttccagaactcctgttacatatatgttggttctcctagaccaatggtctaacgtccatatcattttctcccccccccccaccccctcg

SEQ ID NO: 333908 - DNA, 1867 bp, Homo sapiens
ggcaaaaagtaactgcatctgggcactcttcactctttgccccatagttggaagttaccgctatgtgactctttacctattttcaattaaaattatctttagatttttatttgagtctttaaccctcttaataatttttatagttcctctctactaagcctttttaagttctttatattgttcttaaatgatggaaccttatgactaatgataatcactgtctgaacagtgttgaactatactgggtgcagcatgaccatgaaggctctgggtgaagtcaaggtcacaaactgcttttaaggtcattaggtcataatctcagactcacaaagaactcaaaattggggagacaccactttagattactccaaaactctgggcctgtacttacccactaatttatcaagaggaatcaatatttttattttaaatatgaaactgggataaatgattggatctccacttattaaccagtactgcagtgtgtttatatccttttgtgtggtaggttggataggatttgtaaagctactgattgatctcatgggccagggttcaccaaaaggatgggaatttgtttctgcattcttacatattgggttgcatattccttcataatggatccataagtaactaaggccttggagactaacagttctccaaaatactcagctaaccaaaagaaaatactaatttttaaaatcatgtcataaaaaacagaaaagtaaaaaaagtctgaaatcctgaataaaattattttaaggatgaaattacatgcataaattaagggtagataacttcttgccatttaattaaacaaatccccaattcttatcagaataaaactgaaggacaatggatgccttttgggttttttaattttttaatattgcactttatagtacttcataagagacaactgtcttaattaaagccataaaataccaataatacatatattcagggcttctgaatatagtcaatcaataagcagtccatgagtcattcctgttttgtattgtttattgtaaattggagtttatctgttctattttttattaactacaattattgttctaggcaatcctaatctacttatacattttagatgtgtgctttaataaaactgtttgaaaatcaaagaaattattcatttcacaaaagcagtcttcgttttcaaaatagcttattacagtttctttagcaagttctaatactacatggaaattattttaaaattgtagatttttttcaggaatccattttgttatataaagcaaagttcacccatatggaaaatgaaatagataattagcaaacatatacctgggaaatgtaggatgtgtttgagcttttatataaatataggatgggtctaagaagttcccttataaaaatgggaaatagaggtatacaatttatcaataattccttatgcctaaattactaaccttccttgggaggacatgtaaagcagcagatttcataatgctttggtggttattttcctcctctccgctaaaatacacaatttctaacctagtatggtacactgtttacacacacatatataaagatgtccccacaactaaaaactttaatgtttcaacttcatcacaaatttttatataatttttttttttaacagacagggtcttgctctgtcacccaggctagagtgcagtggtgcaatcatagctcagtgtagcctcaaacacctggactcaagcgatcctcccacttcagcctcttgagtagctgggacctcaggcacatgccaccatgcctggctaattttgttgttgttgttaagagatggagtctcactatgttacccaggctggtctcaaactcctgggctcaagag

SEQ ID NO: 333909 - DNA, 491 bp, Homo sapiens
  misc_feature (489)..(489): n is a, c, g, or t
ttctagaggatccctcaaacgtatcagaactgggtacctaaattgtccatatagagtaaacatgggtactaaactggacaaccccatcaattttatgcttaagtggccaaattgccctaaagaaagggtatctgaaccaagggccagtgatattcctctgttagaggctgttttgtggtctgaagagtttctctaaagggctgagactctattcggaagagggagcctcagttactgaattgcgctattgaaccctgaacacaaagtacacatatataccctgcatctagccttgatatttcttctgctcaagtcaaaaaactccggaagcaacagcttccaccttcaagcaatccacatacttaaaaagccatcaaagctaagaatagcaaaagctaccttcctgattcagtgaagttgctgctagcactaaaagcaagagaaattatacttttgttctgatacggttttgagggatcctctagatcnca

SEQ ID NO: 333910 - DNA, 1031 bp, Homo sapiens
  misc_feature (13)..(13): n is a, c, g, or t
cgtctagaggatncctcaaaccgtatcagaactgggtacctaaattgtccatatagagtaaacatgggtactaaactggacaaccccatcaattttatgcttaagtggccaaattgccctaaagaaagggtatctgaaccaagggccagtgatattcctctgttagaggctgttttgtggtctgaagagtttctctaaagggctgagactctattcggaagagggagcctcagttactgaattgcgctattgaaccctgaacacaaagtacacatatataccctgcatctagccttgatatttcttctgctcaagtcaaaaaactccggaagcaacagcttccaccttcaagcaatccacatacttaaaaagccatcaaagctaagaatagcaaaagctaccttcctgattcagtgaagttgctgctagcactaaaagcaagagaaattatacttttgttcttcagatacggttaaaacaaaggaaatgttgtcaacgttgacgccaacatagacatttgctctataacatataaactgtcttttagacaggttatgttaaaaatatcagaatgccatttttgtaaaggatcttttttaggatagacgtggtctcatgcttcctttgttcgcctccgttttaaaggagcattgtaacccctatcctcatccctacaaaaatccagtggatgcacttccaaattacttctgtcattttgtatgtgttgtgtttattatgcgtaattttcactggatgatgagatacatggtgatactatgtcagtttattctctgtgaatatgtctgtacatagacaggaagctctacttatttgtacataggctgtctgaagtatgtacttctgtcacatggacttcattctgataaagggtgtttcttcttgtttcactgtccatacctttgtgcttctactactgataatcaattcatagaatatcactttatgtaactaagtctcctcagtgtgaaaaataatagtaataaaattattgactcaaagaagtaaaaaaa

SEQ ID NO: 333911 - DNA, 1064 bp, Homo sapiens
gctttggcctcccaaagtgctgggattaaaggaatgagccaccatacccagcccttttatgtaatttgagtaaaagtaattactaaaaaagtaaacatgggtactaaactggacaaccccatcaattttatgcttaagtggccaaattgccctaaagaaagggtatctgaaccaagggccagtgatattcctctgttagaggctgttttgtggtctgaagagtttctctaaagggctgagactctattcggaagagggagcctcagttactgaattgcgctattgaaccctgaacacaaagtacacatatataccctgcatctagccttgatatttcttctgctcaagtcaaaaaactccggaagcaacagcttccaccttcaagcaatccacatacttaaaaagccatcaaagctaagaatagcaaaagctaccttcctgattcagtgaagttgctgctagcactaaaagcaagagaaattatacttttgttcttcagatacggttaaaacaaaggaaatgttgtcaacgttgacgccaacatagacatttgctctataacatataaactgtcttttagacaggttatgttaaaaatatcagaatgccatttttgtaaaggatcttttttaggatagacgtggtctcatgcttcctttgttcgcctccgttttaaaggagcattgtaacccctatcctcatccctacaaaaatccagtggatgcacttccaaattacttctgtcattttgtatgtgttgtgtttattatgcgtaattttcactggatgatgagatacatggtgatactatgtcagtttattctctgtgaatatgtctgtacatagacaggaagctctacttatttgtacataggctgtctgaagtatgtacttctgtcacatggacttcattctgataaagggtgtttcttcttgtttcactgtccatacctttgtgcttctactactgataatcaattcatagaatatcactttatgtaactaagtctcctcagtgtgaaaaataatagtaataaaattattgactcaaagaagtaaaaaaa

SEQ ID NO: 333912 - DNA, 720 bp, Homo sapiens
aatgaaatagataattagcaaacatatacctgggaaatgtaggatgtgtttgagcttttatataaatataggatgggtctaagaagttcccttataaaaatgggaaatagaggtatacaatttatcaataattccttatgcctaaattactaaccttccttgggaggacatgtaaagcagcagatttcataatgctttggtggttattttcctcctctccgctaaaatacacaatttctaacctagtatggtacactgtttacacacacatatataaagatgtccccacaactaaaaactttaatgtttcaacttcatcacaaatttttatataatttttttttttaacagacagggtcttgctctgtcacccaggctagagtgcagtggtgcaatcatagctcagtgtagcctcaaacacctggactcaagcgatcctcccacttcagcctcttgagtagctgggacctcaggcacatgccaccatgcctggctaattttgttgttgttgttaagagatggagtctcactatgttacccaggctggtctcaaactcctgggctcaagagatcctcctgctttggcctcccaaagtgctgggattaaaggaatgagccaccatacccagcccttttatgtaatttgagtaaaagtaattactaaaaagcacttaatagtctagaaatccaccagaactgggtacctaaattgtccatata

SEQ ID NO: 333913 - DNA, 546 bp, Homo sapiens
tacatccctcccccttctttccagggctctgagtgtcagggctgagatgaagatgacaccctggcagaggaggaggcagggtgcttggggcagggcatggacattgaggtctgtgctgagctttacagtttgcaagcactttcatgttatcttgtgggggtagatcattgacatttcttatgccccttctctcctcctcttcctttctgtcctgcaccttagtttgggtccacaacacacctcaacgatgtcgctgtgccacttctccaagtgcaccttctactcccagtctgctagtttgtgagcccagactcgattcttcggtccatgtgatatgttcatacacagggctctccacaaccccacccctgcctactctctctctgccctgtttctcaccattccgcccttgtgcctcacgttccttcttccagcttccgggaggtgcctgctccctccctgctccttgccactatcatgctcatttctctgcctgttttcctcttctccccttctctgactggctgactttattctttaaaacac

SEQ ID NO: 333914 - DNA, 344 bp, Homo sapiens
  misc_feature (56)..(56): n is a, c, g, or t
atatgctattgtttctgcttttcacaatgtgtgtctgaagtccagttcagcatttntttattctccaagtgcaccttctactcccagtctgctagtttgtgagcccagactcgattcttcggtccatgtgatatgttcatacacagggctctccacaaccccacccctgcctactctctctctgccctgtttctcaccattccgcccttgtgcctcacgttccttcttccagcttccgggaggtgcctgctccctccctgctccttgccactatcatgctcatttctctgcctgttttcctcttctccccttctctgactggctgactttattctttaaaacac

SEQ ID NO: 333915 - DNA, 1502 bp, Homo sapiens
cccacatgggcagattgctccattccttatttccatgaggagagatttccctaaaatgccccttgtcctctttccgcttctccttttcttctccccagagaggaggaatgtcttggctgactcatcttcttcacctctcctctttccttttcgtagccagccttatcagcaagctctcattctagtctactctcacgtggctccagctctccaggggcagcctctctgcaggaaggcctcgggtgttcagtgctgcctgtgatgagtgggtctgtctttctcatttggaaaaaatgttgctgaacatttaatgttaccatttccaatgtcagctttatccctaataaagctgacgttttgatctccatctgccttgctctcatcctaccacccgattggtttagaattgtggtggagaaaacaggaactcaattctgggggtctccttacaactccaaaacaaccttattcttcccaaagtcaaccagccatctttaatgtggctatactcctcatctgcgcttcctcatccctcattcattcgccacgtcacggccatgtagcttcttctcccaccaaacattgaacccatcctgccaaggtcgctgatgacttatttgcaaaatacaatgaaaacttttcagtctaaaggtcaatcttacttgaagtctctgcaactttcaaagctcttcatcacttcctcctccttgacattccttcctctctgagcttccatgacactactttctcttggttttcctcctacttctccgactgtccttctcagcctccttgaactgttcttcaacttctgtgcacccaactgctagtgttctccagggttgtgccctacatcctcactctgttgactcttccttggtgattttatccactgccgaggcctctgaccaccacatacccaaaccctgcctgttgcccagggctctctttggagctctagactcaaagggccaagtaccagtggtgtaactccatgtacgacagaagaaggtaccatatcattttattttttatcactttattaatgatagcaagattttttcatattttactgatcagttgtgcatgtttacaggtgtatgtgtataaatcctttcctcacttgacatttcttatgccccttctctcctcctcttcctttctgtcctgcaccttagtttgggtccacaacacacctcaacgatgtcgctgtgccacttctccaagtgcaccttctactcccagtctgctagtttgtgagcccagactcgattcttcggtccatgtgatatgttcatacacagggctctccacaaccccacccctgcctactctctctctgccctgtttctcaccattccgcccttgtgcctcacgttccttcttccagcttccgggaggtgcctgctccctccctgctccttgccactatcatgctcatttctctgcctgttttcctcttctccccttctctgactggctgactttattctttaaaacac

SEQ ID NO: 333916 - DNA, 646 bp, Homo sapiens
cccacatgggcagattgctccattccttatttccatgaggagagatttccctaaaatgccccttgtcctctttccgcttctccttttcttctccccagagaggaggaatgtcttggctgactcatcttcttcacctctcctctttccttttcgtagccagccttatcagcaagctctcattcattgttccagaaatggtcttgaaagcttttcaatgttttggagtcagaatttcgcctgctaaaggaacaattttgaaaggcaaacccattgaaccgtgtaagttctggcacacttatttagagtttgctccttttagcttcctaaaactggaccatctattattccagtttgtttgaaactatctggtttttactggccaatgtcctgttgcctggcctgtggcatgggaccagttggagggaaagttgatgaggtgagtttgggaacctactatttattttgctggtggcttttattgtgttacctcaaattcccttgttagtacagggagagatatcctcaaggtgcaagttggaattttaagtaacaatagcatttgggcattagtacacgtctttcatccaatatggaaacaggaaagtacaccatctttcatccaatatggagatatgagaagtttcac

SEQ ID NO: 333917 - DNA, 513 bp, Homo sapiens
gcacgagatcatgggcaacatggcaaaaccccgtctctactaaaaacagaaaaaattagccaagtgtggtggcccacacctgtattcttagctactcagaggctgaggcatgagaattgcttgaacccgggaggcggaggttgcagggagccaagcttgcgccactgcactccagcctgggtggcagagcgagactccatctcaaaatataaataaataaaaataaaagagtatactcctggcatgctttttatctgagaagatgtaaaacagggaaaagaacttcaggccgttctctttgtggctgagtttcattctgcctgcgtggtgacagcagccttgagctctctgggaattcacatcctgagcagtgtgctaggaggatgcgagggatgctggtgactctgctgtgagtttgagctgcttctgccaaaaaactcacgctcaggactcacaccttgtctatattttgagttacatacaataaagattttttaaaaaatcacagattca

SEQ ID NO: 333918 - DNA, 3748 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333919 - DNA, 3677 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccggttccgccatggaccactcctgccctggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333920 - DNA, 3514 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagtttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333921 - DNA, 3655 bp, Homo sapiens
gttgctagtccctgtaatataaaaatggctgaaaggagttggggaagggggcagtgaagacgacgcctgcctctcgcggtgtgaaactggggacctttgctatatgccgtctattattgtgcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333922 - DNA, 3499 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333923 - DNA, 3571 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333924 - DNA, 3270 bp, Homo sapiens
cggagggcaaactgtgtgtggagctcagctctggccctcaaggctttcgaacggtaggacagaaggcacgacgacccgtccgtcaaggagtggggccaggccacggctgtgttccacttcccctgaggggtgaccatccagtctaggctttatgagagcgtgctgatagatggaggaggaagcaggtgcggccttggagtaggccctcagtgtgatggctggccgtgtccttactcatgaagtggctcaacctacctgtttcgtcagctgtagagggagcatgagacctgccctgcagggtcctcgtgaagaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333925 - DNA, 3005 bp, Homo sapiens
gggcctcacgtgttccagggtagctccaggattctgttgtaaacagaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333926 - DNA, 1969 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagtttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatcaaaaaaaagaattccaccacactggcggccgcaaggag

SEQ ID NO: 333927 - DNA, 1413 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccgcacctggccaacacgaaggggatgacacagatcctctaagtcagccc

SEQ ID NO: 333928 - DNA, 2441 bp, Homo sapiens
ccccaaccccatgcaccaggctgccctggggaagggccaggcaaggcatccccccgactccatgtaccaggttgccctggggaagggccaggtgaggcatctccccgactccatgcaccaggctgccctggggaagggccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccggttccgccatggaccactcctgccctggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333929 - DNA, 775 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333930 - DNA, 299 bp, Homo sapiens
cagctggctgacctcctctgtgtgtgtttcttttttcccacaatttgtgctcctctctgtgtcagatttcagaatgccaagcttaggtatgatgcaagtctttttatttcacgcttaataatagggactccatgaattagctataaccatgtatattttttgtttatttctcacccagggttaccttcccgccaatgtagaccggagaccagccactctccagagaaaacaaaaagaatattttgcatttattgagcactattacgattctaggaacgacgaagttcaccaggacacat

SEQ ID NO: 333931 - DNA, 3780 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccggttccgccatggaccactcctgccctggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333932 - DNA, 3638 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacataggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333933 - DNA, 3739 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaaggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccggttccgccatggaccactcctgccctggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333934 - DNA, 3370 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcgg

SEQ ID NO: 333935 - DNA, 2273 bp, Homo sapiens
  misc_feature (2209)..(2209): n is a, c, g, or t
  misc_feature (2219)..(2219): n is a, c, g, or t
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatcaaaaaaaaaaaaaaaaaaaaaaaaaaaaaaaaaaaaaaaaaaanaaaaaaaaanaaaaaaaaaaaaaaaaaaaaaaaaaaaaaaaaaaaaaaaaaaaaaaaaaaaaaa

SEQ ID NO: 333936 - DNA, 1343 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcagacaactacacctttgcccaacctgggacccttggggcttaagggacccttgggggtaccgagctcg

SEQ ID NO: 333937 - DNA, 1485 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacataggtaagatttcttgcaaacattaaacgtgaactttagtggacttgctgtgtgttactatgtataattataacaatattgaaaattgctactaagtgtaatgttattaatgataggtaatattagagaataatagttttctcatcaacaacagctttccaaaatgtctttaatctacatgctcaactactgaagacattaaattgcagttataatgatgaatatcttctttttaacaatatttgaagatagataatatatttggggagtgtagtttattctaaaggccatcacagtaatggctttaatggtttcagtcat

SEQ ID NO: 333938 - DNA, 1222 bp, Homo sapiens
agcggggtaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaatataaataaataaaaataaaagagtatactcctggcatgctttttatctgagaagatgtaaaacagggaaaagaacttcaggccgttctctttgtggctgagtttcattctgcctgcgtggtgacagcagccttgagctctctgggaattcacatcctgagcagtgtgctaggaggatgcgagggatgctggtgactctgctgtgagtttgagctgcttctgccaaaaaactcacgctcaggactcacaccttgtctatattttgagttacatacaataaagattttttaaaaaatcacagattca

SEQ ID NO: 333939 - DNA, 476 bp, Homo sapiens
ccgcctcggcctcccaaagtgctggaactacaggtgtgagccaccacgcctggcagctttgtgttcttttctttctgtgatcttgccttagatcacacagataaaacatgacaggacctggaccttaacacagtttggctctcaatcctgttctcataaccatcactgccttcatttatctgtgtcatcctcagacctgacacatagtaggtgctcagtcagtgttcactaagtaaatgatgaccaagaactctttgactgggtccaaggtgcttatcccaatacttcgccatggctacctccctcattcctcagctgacttgctctctctagcctggctgctcctattttatgtcctagacatggagccatggcaatgatgtagagctaacaggtgatacggtagccatcataatttaatgagtatggggctcatgcaaccacaagacacaggagccgagagctagctgtgcaca

SEQ ID NO: 333940 - DNA, 749 bp, Homo sapiens
gccgatgcgcagccgctggtcccggacaccaagaccaggaatgactgtgggagtctggcattctacagagagtgctgctgacctccagcgggacggctctcagggtgacccagcagggcccaagtgctgctcccttgttgcctcacttgcccttccccaacgtagcaggaggcagtccaggcatgagggattcagcctgttggggcagtcacgcccatgggatggggctagggaccataggaatgaaccccctcaccccatggagcttctaaagtgttaccacagtggggaagaggaagggccaaggctgttgtcccgaaattacagagtcgtggtgagtccccatggagcagcctcccaaggtcacattgctctgaaatggcagagtcaggacttgaacccaggtctgccctctcagcgatgggtcctctgcctcttctgtgtcgagggaggtagggcctggcccgggccttcctcactcagctttgtcagatagggagtcaagctgcagctctctgtggctacacttatgtccagccctggactaggagtcaggaaagccggcttctgcccccacctacccctctcaccaaatggcatacggacttctcccaagacctcctctcctctggccttttcctaagactgagaaatgaatgccttgcaaccttgggcaagttcctgctccaagcctccgtttcccggtttgaagatggtgttggctttgctccccacctgtctcacccact

SEQ ID NO: 333941 - DNA, 1946 bp, Homo sapiens
cgcgcatagcgcccacgcacgcgcactggggtgtccgccgggcatcgctctgtccagttattccagtttctctgggagcagccgagttgaccccacggtctgagatgtccaagctgcccgcagacagcagtgtcccgcagacaggcgcggcgaatggtgacagagacgtcccgcaggcggaggtaggccgcgggaggcgggagccggccccggcacagcctgaggaggccggggaaggcgcgatggcggcggccaggggaggcccggtgccggcggccagggaaggtcggatggcggcggccagggcagccccggcggcggcagccaggggagccccggtggcagcggcggcgttggccagggcagccgcggcgggcagggaaagcccggcggcggcggcggccagggaagcccggatggcggaggtcgcccgcttgctgggggagccagtggacgaagagggtcccgagggcaggcccaggtccagacacgggaacggaggcctggctgcgttgccctatctccgtctccgccacccacttagcgttttaggcatcaattaccagcagtttctccgccactatctggaaaattacccgattgctcccggcagaatacaagagcttgaagaacgccgcaggcgattcgtggaagcctgcagagcaagggaagcagcgtttgatgccgaatatcaggcgaaatcctcacagggtggacctcgatattttaacctttacgatagctctgactgcctctgaagttatcaaccctctgatagaagaacttggttgcgataagtttatcaatagagaatagttatgtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaacgtcaaatttctggacttttttctttcaatttttaatttttaaagtttttttggtattaaaaaatctattcacaagccaaaaaatatataaaatatacagcgaaaagccttccattcttgttttcctccatccagtaccaacgatgacctctaatagccacagtttcctttccgtccttctagtttccttacgtgtacacaggcacatataaatctgggtttacttgttttatttcttcacagaagtcggcatattatatttactggtttatacattgctttctcattaagaacatatgttgacccttccaaaccactgtatttcctcattattttttaaagtggcattttattccattctgaggttatgtccaaatttacttaaccagggatatattgacggacatttaggttgtttcccatctctttctttgggcagaataaaaaattgctagagtagttcatcttgtacaattgctagagtagttcatcttgtatatcatgtggcatgtgcacaaatatagtattgcttcaattaaaaattcacttcatatttgaacatctctgaaatgtg

SEQ ID NO: 333942 - DNA, 1420 bp, Homo sapiens
cgcgcatagcgcccacgcacgcgcactggggtgtccgccgggcatcgctctgtccagttattccagtttctctgggagcagccgagttgaccccacggtctgagatgtccaagctgcccgcagacagcagtgtcccgcagacaggcgcggcgaatggtgacagagacgtcccgcaggcggaggtaggccgcgggaggcgggagccggccccggcacagcctgaggaggccggggaaggcgcgatggcggcggccaggggaggcccggtgccggcggccagggaaggtcggatggcggcggccagggcagccccggcggcggcagccaggggagccccggtggcagcggcggcgttggccagggcagccgcggcgggcagggaaagcccggcggcggcggcggccagggaagcccggatggcgtatgtgttcgcgcccggctttttgcctggggggggacaaccccatgttggacacccgaaaggaagggtgcccccccgagagggggcaaggcgcccccagggtcccaggacacgggcaaacgggaagggcctggctgcgttgccctatctccgtctccgccacccacttagcgttttaggcatcaattaccagcagtttctccgccactatctggaaaattacccgattgctcccggcagaatacaagagcttgaagaacgccgcaggcgattcgtggaagcctgcagagcaagggaagcagcgtttgatgccgaatatcaggcgaaatcctcacagggtggacctcgatattttaacctttacgatagctctgactgcctctgaagttatcaaccctctgatagaagaacttggttgcgataagtttatcaatagagaatagttatgtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaa

SEQ ID NO: 333943 - DNA, 1372 bp, Homo sapiens
cgcgcatagcgcccacgcacgcgcactggggtgtccgccgggcatcgctctgtccagttattccagtttctctgggagcagccgagttgaccccacggtctgagatgtccaagctgcccgcagacagcagtgtcccgcagacaggcgcggcgaatggtgacagagacgtcccgcaggcggaggtaggccgcgggaggcgggagccggccccggcacagcctgaggaggccggggaaggcgcgatggcggcggccaggggaggcccggtgccggcggccagggaaggtcggatggcggcggccagggcagccccggcggcggcagccaggggagccccggtggcagcggcggcgttggccagggcagccgcggcgggcagggaaagcccggcggcggcggcggccagggaagcccggatggcggaggtcgcccgcttgctgggggagccagtggacgaagagggtcccgagggcaggcccaggtccagacacgggaacggaggcctggctgcgttgccctatctccgtctccgccacccacttagcgttttaggcatcaattaccagcagtttctccgccactatctggaaaattacccgattgctcccggcagaatacaagagcttgaagaacgccgcaggcgattcgtggaagcctgcagagcaagggaagcagcgtttgatgccgaatatcaggcgaaatcctcacagggtggacctcgatattttaacctttacgatagctctgactgcctctgaagttatcaaccctctgatagaagaacttggttgcgataagtttatcaatagagaatagttatgtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaa

SEQ ID NO: 333944 - DNA, 1440 bp, Homo sapiens
cgcgcatagcgcccacgcacgcgcactggggtgtccgccgggcatcgctctgtccagttattccagtttctctgggagcagccgagttgaccccacggtctgagatgtccaagctgcccgcagacagcagtgtcccgcagacaggcgcggcgaatggtgacagagacgtcccgcaggcggaggtaggccgcgggaggcgggagccggccccggcacagcctgaggaggccggggaaggcgcgatggcggcggccaggggaggcccggtgccggcggccagggaaggtcggatggcggcggccagggcagccccggcggcggcagccaggggagccccggtggcagcggcggcgttggccagggcagccgcggcgggcagggaaagcccggcggcggcggcggccagggaagcccggatggcggaggtcgcccgcttgctgggggagccagtggacgaagagggtcccgagggcaggcccaggtccagacacgggaacggaggcctggctgcgttgccctatctccgtctccgccacccacttagcgttttaggcatcaattaccagcagtttctccgccactatctggaaaattacccgattgctcccggcagaatacaagagcttgaagaacgccgcaggcgattcgtggaagcctgcagagcaagggaagcagcgtttgatgccgaatatcaggcgaaatcctcacagggtggacctcgatattttaacctttacgatagctctgactgcctctgaagttatcaaccctctgatagaagaacttggttgcgataagtttatcaatagagaatagttatgtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaaaaaccaaaaaaatcctcggggcccaggcggggccaaaaaagcatggatggcctggcaagggtccgaca

SEQ ID NO: 333945 - DNA, 154 bp, Homo sapiens
tgccactgtgcaaattagctgtgcagcatcccaggggcaccccaagcaggcttgcccagcctcatgcaatgctttctgttgagctatcaggagagtgtatgctctggccccatctctccattctcaagatactttttcaacccctactagaaag

SEQ ID NO: 333946 - DNA, 418 bp, Homo sapiens
gagccaggagagtgatagcttggggtaccattccccatctgtttctgggggagcctgctgcagtactactctctggtctgccctggaaaaacccagaagcatactgcatcacagcttgagaaattacatctatagggggagcagggagctagataccatgaataccaataatatgagggatacccgtggaactggtgctggaagagatgaaaagaagttatgcatggaggcaggttgcagctgggtaggcctgagctgtagcttccagttccagggaaaatcataggcggaatggatgaaaagaaactggaatatgaccaacagcttctgtgaagaacataacagcttgtatgaatagaaaaagtgcagtgggcacccagatttgaactggggacctcttgatctgcagtcaaatgct

SEQ ID NO: 333947 - DNA, 373 bp, Homo sapiens
aatcttaatcagaaccctcccaatagcccttggcaccaggaaatagcttccagtgacgtggaagaacaaggttaactttgcagacactcatgttgttagaatttttaatatgcttttcaccgactattctaaactctgtagcatgagtgataatggacaatcatattgccctggacttcctgctggccagtgagtgtgggaggtgtgtggttgataacacctcatgctgcacctgggttagtaacatatttcactggcttaactccagatgtggcatctggctatggtctgattgcactaatgtaatagcatgatcactctcatctaattttgcccaagacaaacagaacagacttggtctgatacgtttaca

SEQ ID NO: 333948 - DNA, 399 bp, Homo sapiens
gctcttccctgtgccaggagaaggggcggctctggaaggccaagctgccagccccgcctgccctttcctctagccgccccgtcacatgcccatgagccctgcaacacggtcttcattttcttctttttttgagtgactggatgccaaaacacattcttttcaattaggccacaggatttcattcagaccacaggctgcatgccgccactttaaaccatcgtgcgaaagaaaaaaataactgcacaaacaatagtcaacaccatagatatctcaattggcttagcttacactattctgactgaaaatttaaagttgagcaaactttccactcaatgggtaccaaaactgttgtgcccagatcagctgcagacaagagctgagcttccaatggaaattttt

SEQ ID NO: 333949 - DNA, 363 bp, Homo sapiens
tgtactctcaaactaccagtgcgtgccacgatgcctgactaatttttgtattttttgtagagatggggttttgccatgttgcccaggctggtcttgaactcctgggctcaagcaatccgcccacctcagccttccacagcgctgagattacaggcgtgagccaccacgcccggcaacgttttcttataacattgaaagctgaagacaatacaattacccatcaacagagaaccagataaatgaagtgtggaacatccacagcgtcgaataaaatcatggtgtggatctgtatttcctgacaactaaagattccgtgataaagtgtgaagcgaaaaaaagcaagctgccaaacaacatgtagaa

SEQ ID NO: 333950 - DNA, 330 bp, Homo sapiens
atttctcttaggaacctgagtcctctatctatgcttcctaattctcagcaacaccctttggaagaaagtatatagcaatgataacctggacttgactagagaataactattagacactgtctggccacagggtcactaggttctcattgaagctaagctgacaatataacaccttataacttttcatcttttcaagtttaccaagtgttatctggaagaagcacatgattatgttaaatgtatataactccacattgtaaacttaatgtttggagagaaaagaacacatttcttaattttaataacagcatctttttttttttttctttt

SEQ ID NO: 333951 - DNA, 3562 bp, Homo sapiens
ctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggcttttttttttgatatacataagataccactttataaagaagctccatactatagaacctcccctaacaggcttaaaataccttctttttttttttttttttttggaaaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgtta

SEQ ID NO: 333952 - DNA, 3509 bp, Homo sapiens
ctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaataccactttataaagaagctccatactatagaacctcccctaacaggcttaaaataccttctttttttttttttttttttggaaaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgtta

SEQ ID NO: 333953 - DNA, 3628 bp, Homo sapiens
ctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagaatgtcttattcttgggctgtagcagtggacaatttaagaagaagtatacccactctaaagggactggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggcttttttttttgatatacataagataccactttataaagaagctccatactatagaacctcccctaacaggcttaaaataccttctttttttttttttttttttggaaaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgtta

SEQ ID NO: 333954 - DNA, 3575 bp, Homo sapiens
ctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagaatgtcttattcttgggctgtagcagtggacaatttaagaagaagtatacccactctaaagggactggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaataatatttccttctgcctagggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggcttttttttttgatatacataagataccactttataaagaagctccatactatagaacctcccctaacaggcttaaaataccttctttttttttttttttttttggaaaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgtta

SEQ ID NO: 333955 - DNA, 2976 bp, Homo sapiens
aggcaggaggtgacaatcaagctgttggccaggacagcagtatataaagacgactggaactggagaacacacttttttagctcatcacatggcttttggcagaaggcttcagttcctcaccatgttggtctctccaaagggttgttcatgttatctcttcctctagagcagggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggcttttttttttgatatacataagataccactttataaagaagctccatactatagaacctcccctaacaggcttaaaataccttctttttttttttttttttttggaaaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgtta

SEQ ID NO: 333956 - DNA, 2684 bp, Homo sapiens
catccgcgatccgcagaacacgagtggtagctagaaacaggatcaaaggcctgggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggcttttttttttgatatacataagataccactttataaagaagctccatactatagaacctcccctaacaggcttaaaataccttctttttttttttttttttttggaaaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgtta

SEQ ID NO: 333957 - DNA, 1627 bp, Homo sapiens
ctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaa

SEQ ID NO: 333958 - DNA, 414 bp, Homo sapiens
tgcataattgctctccaactgcaatatctctgttcccatcaatgtatgaaaatacttgtctcatcatacccatactagcacattatttaccagtttttaactttgttcatttagaacttcctcctaatttctaagaattttctatattttaagtaggttattcctttttgatttttagcatgtttttagaattaaaactaagaattatgtgatttttgtttctaggtcattcaatattaacagggttgcaactcaggctgtagaagatgttttaaatattggtgagtaccaaaacagctattggagtagtcccctcttatccgcaggggacaagttccagaacccccagtgaatgctgaaaccttggatactaccaaacccttatactatgcattaatttctttttctttcttc

SEQ ID NO: 333959 - DNA, 409 bp, Homo sapiens
cgagggggggctactgtttatttatgataatatgctatataatgtatacatgttgttttatattagctattatgttacataataacatatatatatataacacatatacactttaagcatttttccccctttttcaaggaaaatatatatataagatatatatatttataacatacattttccccctttcctttttcaacagccaaaacgacaaggaaatttgagtcttccattgaacagagaattggtagagaaaggtcagtgacaaatgataataatcactaacagtttagttctgtttcagttttaaggatgatagtgtgaagtgttgtttaattagcaaagtacttttttttactcaaacatgcttttaatacaatatccccttaaatgtctttaagcaacataa

SEQ ID NO: 333960 - DNA, 3406 bp, Homo sapiens
agccgccgcgggctctgattggccgatagagttagcctgggggcgggagaagagcgacctcggggaagcgtgtggtgcggggaggtcgcccccgggcggcgaagcggccattatgcaggccttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggcttttttttttgatatacataagataccactttataaagaagctccatactatagaacctcccctaacaggcttaaaataccttctttttttttttttttttttggaaaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgtta

SEQ ID NO: 333961 - DNA, 3539 bp, Homo sapiens
agccgccgcgggctctgattggccgatagagttagcctgggggcgggagaagagcgacctcggggaagcgtgtggtgcggggaggtcgcccccgggcggcgaagcggccattatgcaggcgtgagtgaaacgaataaacaaacaaacaaaacccactagctggggcctccatttcttccccgcccacctttctcccgcgtggggtctcccgtttcccaatcgccacgctttccccgccttcgtcaacgcctggcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggcttttttttttgatatacataagataccactttataaagaagctccatactatagaacctcccctaacaggcttaaaataccttctttttttttttttttttttggaaaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgtta

SEQ ID NO: 333962 - DNA, 3508 bp, Homo sapiens
ctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggcttttttttttgatatacataagataccactttataaagaagctccatactatagaacctcccctaacaggcttaaaataccttctttttttttttttttttttggaaaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgtta

SEQ ID NO: 333963 - DNA, 2174 bp, Homo sapiens
  misc_feature (1704)..(1704): n is a, c, g, or t
  misc_feature (1712)..(1712): n is a, c, g, or t
  misc_feature (1726)..(1726): n is a, c, g, or t
  misc_feature (1729)..(1730): n is a, c, g, or t
  misc_feature (1736)..(1736): n is a, c, g, or t
  misc_feature (1740)..(1740): n is a, c, g, or t
  misc_feature (1744)..(1744): n is a, c, g, or t
  misc_feature (1746)..(1746): n is a, c, g, or t
  misc_feature (1779)..(1779): n is a, c, g, or t
  misc_feature (1783)..(1783): n is a, c, g, or t
  misc_feature (1788)..(1788): n is a, c, g, or t
  misc_feature (1802)..(1802): n is a, c, g, or t
  misc_feature (1808)..(1808): n is a, c, g, or t
  misc_feature (1810)..(1810): n is a, c, g, or t
  misc_feature (1838)..(1838): n is a, c, g, or t
  misc_feature (1843)..(1843): n is a, c, g, or t
  misc_feature (1861)..(1861): n is a, c, g, or t
  misc_feature (1874)..(1874): n is a, c, g, or t
  misc_feature (1879)..(1879): n is a, c, g, or t
  misc_feature (1912)..(1912): n is a, c, g, or t
  misc_feature (1914)..(1914): n is a, c, g, or t
  misc_feature (1919)..(1919): n is a, c, g, or t
  misc_feature (1922)..(1922): n is a, c, g, or t
  misc_feature (1946)..(1946): n is a, c, g, or t
  misc_feature (1950)..(1950): n is a, c, g, or t
  misc_feature (1954)..(1954): n is a, c, g, or t
  misc_feature (1965)..(1966): n is a, c, g, or t
  misc_feature (1969)..(1969): n is a, c, g, or t
  misc_feature (1985)..(1985): n is a, c, g, or t
  misc_feature (2001)..(2001): n is a, c, g, or t
  misc_feature (2023)..(2023): n is a, c, g, or t
  misc_feature (2036)..(2036): n is a, c, g, or t
  misc_feature (2049)..(2049): n is a, c, g, or t
ctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaaaaaaaaaaaaaaaaaaaaaaaaaaaaaaaaaaaaaaaaaaaaaaaaaaaaaaaaaaaaaaaaaaaaaaaaaaaaaancttgtggnccgcttgggccaantcnnttttanattnggcnangtttatgcatggggccgaatttggggctaattnggcnaattngccttatggggggncgtttnanaattaatgggccggggtttaaaaacgtnggaantggaaaaaccttggggtncccaaattaaatngcttngaagaaaatccccttttggcaagttggggaaanancaaanggncccgaaccgatggcctttccaaanagtngccnaccctgaatgnnaangggaaattgaaggcgnaaaaatttggtaaaantccgggtaaaattttggtaaancagttaatttttnaaccaatgggccnaattggggaaaaacccttttaaaatcaaagagaattgccccgaatgggtttgaagggttgtcccatttggaaacaagggttcccctttttaaagacacgtggccttcaacggtaaaaagcggaaa

SEQ ID NO: 333964 - DNA, 275 bp, Homo sapiens
tgtatgtgtagtatatctgtgcttcatacataaaaacagtgtagatttttggcccccaaaaccaatttgtgagcatatgctgaaggaaaagagatggggagtggaggccgagagtgcaggagagaagtgtatagagccctacagtagggttctgaagaggtgggaagagatgagctgcaaagccaggcagagggtccacgagagggcatggcgagccgagatgatgggtgtatgggacaggaagcaaaaaggtaggggatcactgcctggtggtg

SEQ ID NO: 333965 - DNA, 1033 bp, Homo sapiens
tcatgaggaagcgatggtttggggacaggtgattagccagacttcattcttgggcagctagaacctgctgggaggtgaaagagatggcattctaggctagaatgaaaagtgcaggatgagatcacagggcagagacagcaggtagagtatgaatgtgtgcactgggctgtgagctgcttctggcctggatgggtcaagagagcccttaaagaggtggacagggagagttctgggggatatgcatcttcctcctctgggcgttggggattgactcctccttgtctgtgctgtgttcatttgtggtaagttaggaaacatctgcctttagcggaaccagaggtaaaaggcgggagagaaggtgaaagggagaggacaaggttgatgagtttgatagttacctgtgaggcccagttagtcttcctgtccagacatttaggtgggctggggctggggctgggaccaggaccaaggaaggaaaatagagatgctgggaagtagggcctggattatcagggctgagggattgatgattaaagaggggcccggctaggccaaggtgaggaataggaggggaccaggaagagaaatcacttgatgagcagttgtcataggaagtgcagttagtaactgttaagctatccggactcagccaattggttccaaactctactgataggtctactgctccctcttctatcctttagtcattcttacagggttgtttcaaagatcagatgagatagtatataacgtgcttactacattgctgtaggtgctcaagttttaccacccaccccctcagacatttacttaaaatatattctgggggctgggcacggtggctcacacctgtaatcccagcactttgagaggccaaggtgggcggatcacttgaggtcaggtgttcaagaccagcctggccaacatggtgaaaccccgtctgtactaaaaatacaaaaattagccaggcgtggtggcgggtgcctgtaatcccaggtactcaggaggctgaggcagagagaattgcttgaac

SEQ ID NO: 333966 - DNA, 270 bp, Homo sapiens
tgatgatggatgaatggaatgccattagcaagaaaaagggaagcaagggcattgcaaacagtgggaagagtgtgggatcacagtggagcctggttgattttttaaaaaacagacatttcccagttttctgcattccacatacagaaccttctttcctagaagaccaagctcctttctgcctctttcccagacccccatcccatcttgcctttttaattgatattcagtgttgagcaaaactctcctcagggaacttcttcctcaccttcc

SEQ ID NO: 333967 - DNA, 819 bp, Homo sapiens
atatgtctgtctttttctgtacttaatatcttaatagctattttaattttcattttaatatttgctaatccaggccaggtgtgttagttcacacttgtaattccagcactttgggaagctgaggctggcggatcacttgaggtcaggagtttgagaccagcttggccaacgtagtgaaccccgtctctactaaaaacacaaaaattagcttggtgtgatggcagacacctgtaatcccagctactcagaggctgaggtgggataattgcttgaacctgggaggtggaggttgcagtgagccaagatagccccgctgtactccagcctgggtgacagagcaagactccgcctcaaaaaaaaaaaagtgcgaatccaacgtctacgttatttgtttgtttatatttgctattctttcttatttatggtcatattttcttgctgctttgcatgtccattaatttattttatactgcatgtcatggatttggtggttttaactttgttctggcaggcagttaatttgctggaaaatcattttgatcctttcaagttttgattttaaagttagggtgggtctagaggtaggggtctgcagacttacagggccagttagagtaaatagtttaggcttgtgggccatacagcctttgtctaaactgttcgtctctgtttttattgtgcaaaagtagttatagacagcacagaagtgaatgggcgtggctgtgttccaatacaatatgggctcatgagccatggtttgctgactcttggtctagagtatcctttaggcttagagtagtcctgcttgaggtgtttaga

SEQ ID NO: 333968 - DNA, 514 bp, Homo sapiens
tatttgttcagactccagaacaaaatttagtaactattctgtggtattggttttaatcagtaatcctcatttgtgtcctccacctgtaaatataataaatttccctttttccttttatatcaataagttattgctacaatgattaccatccacagcttcgtatctgcagagtaatgatctaagatatttatttctggccagataattctttgcaatctattatgtttggctgcaaatgaagatactgaattatacaaggcagaaccttaagttcgtctggtgctctgtaccaacatggaaatagtgaatatgtaaatgtattaaaatgagatcactctaggaacctgtctgcattcagaaagaattttgactaagcttatatttaattaatcatgtgcatatatacttttcaatatcaagtcttattacttgattcaaaacaagtgaccaattctagtatgaagtttttgtgactacttaataagaagtaattttatggcttttgtcataaagc

SEQ ID NO: 333969 - DNA, 672 bp, Homo sapiens
taaatggaattctcttatttttgcttgatttttttttcaagctttatgttgcataagagggttttttgcattttgcataaattctgtgtgcagtcatggggatctcacatttttaaaccctcccctgcagtttctgtggctcagctcttctggccaattgcctaacctgctggagttctaggggaggagaaaagattgagagaagtggtgtctcctcctggtgcctccctctcgcccctgaaattcagtccagccaattcagtgatggggcttcccagggcagaagagtggaggtaagctcgataaaccacagggcctggctgagtggggaggcagagcactcagcagcagcagagcctggtgggaagatcttccttcccaagggcctgagagccacgctgataacatcttttctacctccacagtcacagagcacaatagggagaaggggtactggttctgaacagaatgggttcccttcatagagccgatgtttcagaaaatactgctttttgttcttaaactctgttttcttactccccacccccagttttttttttaagtctataaaatgcaagataaattttaccattgtttgttgtctgtttttatctgcagcaggctaatttttaaaacatgaaatatagtaacatatgaagagatggatttttc

SEQ ID NO: 333970 - DNA, 4301 bp, Homo sapiens
  misc_feature (2170)..(2170): n is a, c, g, or t
  misc_feature (2245)..(2245): n is a, c, g, or t
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaggatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggncttgaaactgctgagggattggactgtgtcagaactattgaagaattagcaagagtcctcagaaaacattcaggnctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagtcatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcaaaatttcaacctgtaaaaaaaaaaacatta

SEQ ID NO: 333971 - DNA, 3836 bp, Homo sapiens
  misc_feature (1705)..(1705): n is a, c, g, or t
  misc_feature (1780)..(1780): n is a, c, g, or t
taaatggaattctcttatttttgcttgatttttttttcaagctttatgttgcataagagggttttttgcattttgcataaattctgtgtgcagtcatggggatctcacatttttaaaccctcccctgcagtttctgtggctcagctcttctggccaattgcctaacctgctggagttctaggggaggagaaaagattgagagaagtggtgtctcctcctggtgcctccctctcgcccctgaaattcagtccagccaattcagtgatggggcttcccagggcagaagagtggagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaggatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggncttgaaactgctgagggattggactgtgtcagaactattgaagaattagcaagagtcctcagaaaacattcaggnctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagtcatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcaaaatttcaacctgtaaaaaaaaaaacatta

SEQ ID NO: 333972 - DNA, 4440 bp, Homo sapiens
  misc_feature (2170)..(2170): n is a, c, g, or t
  misc_feature (2245)..(2245): n is a, c, g, or t
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaggatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggncttgaaactgctgagggattggactgtgtcagaactattgaagaattagcaagagtcctcagaaaacattcaggnctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggaatgtctaaatcagattgtatgtttggatcgccctcacctgtcccattgaaaccaactggtttatttgttcaggcagtgcttttacatgaagacaaaaagaaacaaaaaacaacaatatttttgagtccccagtcagggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagtcatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcaaaatttcaacctgtaaaaaaaaaaacatta

SEQ ID NO: 333973 - DNA, 4366 bp, Homo sapiens
  misc_feature (2170)..(2170): n is a, c, g, or t
  misc_feature (2245)..(2245): n is a, c, g, or t
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaggatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggncttgaaactgctgagggattggactgtgtcagaactattgaagaattagcaagagtcctcagaaaacattcaggnctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggcagtgcttttacatgaagacaaaaagaaacaaaaaacaacaatatttttgagtccccagtcagggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagtcatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcaaaatttcaacctgtaaaaaaaaaaacatta

SEQ ID NO: 333974 - DNA, 1649 bp, Homo sapiens
cttggccccccatatattttgagtggaagtttttgtcccaccaccaaaccagtttgaaaacagggctactgctttcaatttaaagtaggaacaaaaagtgctaatttcttttttaggaatgtctaaatcagattgtatgtttggatcgccctcacctgtcccattgaaaccaactggtttatttgttcaggtaaacctagctcaaacggagaaggaggcgtgtctgtcatctgttcactcaggagctgctccctgagtgctctcagctctgcaccatgtccttgcgctgtgctggcagtgtgggccctccttcctctggctgacctgcagcactcctgtctgtcctgcgcgggtgtggtgcgtggtgaggcttactgggcaccggatggcggggccttgtttcagaactcctgcccatggtcttgcttttcagttaacttgcaaaattctgccacccacatgccttatttcagctctccttggatatggtttcggttttaaggctgtttcagatgctcttcctttcgattttgtaaaccagtctatttcattttttaggcagtgcttttacatgaagacaaaaagaaacaaaaaacaacaatatttttgagtccccagtcagggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagtcatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcaaaatttcaacctgtaaaaaaaaaaacatta

SEQ ID NO: 333975 - DNA, 3443 bp, Homo sapiens
  misc_feature (2170)..(2170): n is a, c, g, or t
  misc_feature (2245)..(2245): n is a, c, g, or t
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaggatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggncttgaaactgctgagggattggactgtgtcagaactattgaagaattagcaagagtcctcagaaaacattcaggnctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaagatcaaatgaatgaaatgaagcgagaagaatagtttagagaaaagcataattagaaatgaacaaagcctccaagatatatgggatctatgtgtcg

SEQ ID NO: 333976 - DNA, 2227 bp, Homo sapiens
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaaggtaatcagtaccaccactagtcatagaactaggagactttaaggactttgaatgcatttaatttcaatttttatatactaggaattttcctattttggtagtgttgaacaagttggcctttcattctgatatgactgctcggtctgcttttctccttaagactcatgggaattagcagaggaagggaatgctattagtagtgaaaatagccactatgttctcctaatgatactataggatgtccccatctctcagatcatttgagtggatgcatgttatattttcatttcctttggaaagtgaataggtgactgtgtacttttaaaacatgattccagactcctttatttggcaaataaagtgttaagtcttgttttgctt

SEQ ID NO: 333977 - DNA, 2709 bp, Homo sapiens
  misc_feature (2170)..(2170): n is a, c, g, or t
  misc_feature (2245)..(2245): n is a, c, g, or t
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaggatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggncttgaaactgctgagggattggactgtgtcagaactattgaagaattagcaagagtcctcagaaaacattcaggnctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaaggtgagtatgctaccatattgtgacttatcaggaaatttcattgcatctttaaacactgttggaaacataaatctattttttaatgaactgtagtcatgtgaaatgcttcatgtagctatatgggagaccctatgaagaaagctaaaattttgttctgaattttatacaatgacctgatcttgcacgtagccagctgtccactgctttgctaggttggattggttttgcctttgacaatgtgatttttatattagttctcaaaatatgcactt

SEQ ID NO: 333978 - DNA, 247 bp, Homo sapiens
gctcggtcccttgaaatgggcacagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcaaaatttcaacctgtaaaaaaaaaaacatta

SEQ ID NO: 333979 - DNA, 580 bp, Homo sapiens
gtatggacacctatcacaccttgatgtttgctctaacatctcaagggaaatctgctttttagagctctttactattttagttatctttatttctttatcaatatatttactcaaaaaagatcttgtttttaagaaagtaaaatcccttccccctcctttaatgttgatcctccatatatcttattcctggctttatttagagtcttatgagagtcatttggtgaacttttctaagattatcagtgaggtgaaagtgtaatcatccctggtacctgcacatgtagcctcagtgaccagaaaagaagctgcaacttgagctttgctacttgatatatgtacttgtgaaatcaaatcacaggggtggcggtagccagagttatctcaggacaccatgctctgtgcacaggtgagccacacacaggcacatgcatagaaaagggaacagaaagaaataggctgcatagttagcagtgggtgaatctgcagaggggaattatggaagatttttttctgtagattttgtcattttgattttctacaagtgagcatgattattcttatgacgaagaaaatatctatt

SEQ ID NO: 333980 - DNA, 273 bp, Homo sapiens
atgttgtcgaatttgtggaaaaatcggacacttcatgaaggactgtcctatgaggagaaagtaagtaaatgttcaaaggggttggttgtgtttttattttcttaatgtcccaatttttaaatgaggtactattataacaaagaaaatacacttgtgtaaaatccagcagttttcagatacatttaagttttttattttattttttaatgaaatgaagtgatttaaaacatgactttaggccgggtgcagtggttcacgcctgtaatcccagca

SEQ ID NO: 333981 - DNA, 195 bp, Homo sapiens
ttgaattgtaagataactgtttaatatctggttagttttgtgttccgatctcacgtgaatagttcaggcttttatatatttatgttcttctaggaatacttttttgatccagatgtgttaactgaaggagagctggccccaaatgatagatgttgtcgaatttgtggaaaaatcggacacttcatgaaggactgt

SEQ ID NO: 333982 - DNA, 962 bp, Homo sapiens
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatgggtataaaacattttttttgcttatatatctgaacagattttattacaggtccacaattaaattttgcataatttcaaaatctagacacctaaccagaactgacatggatttatttattctactcatgtgaatattcatacctttcactgctgaaatactaatgtgtttgatttcagtatgttgccctataacctgcttagggatattattacctttctagactgcaaaatctcttaatttttgaaatatgtatggtcctgagacgaacaagagactgaccctgtaaatttaccatttggtacattctttctttgggtacagttttctaaattgatacttgaatttacatatcacctccagacagacagactgtgggaagcatttggttcactgtaacttactttctgtttctaatctatttctccccataacctgtaaaacaaaaaaatatataaacattgaaattgctacctgtaccacaagatgcagaacctagtagtcatctcttgaataatattttgacattattttaaagatg

SEQ ID NO: 333983 - DNA, 4415 bp, Homo sapiens
  misc_feature (2170)..(2170): n is a, c, g, or t
  misc_feature (2245)..(2245): n is a, c, g, or t
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaggatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggncttgaaactgctgagggattggactgtgtcagaactattgaagaattagcaagagtcctcagaaaacattcaggnctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatgtgtgatattggtgatgcatctagaggcagcttatcatcgtatgcatatactcttatggtgctatattttctccagcagaggaatccaccagtcattcctgtccttcaagagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagtcatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcaaaatttcaacctgtaaaaaaaaaaacatta

SEQ ID NO: 333984 - DNA, 4808 bp, Homo sapiens
  misc_feature (2170)..(2170): n is a, c, g, or t
  misc_feature (2245)..(2245): n is a, c, g, or t
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaggatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggncttgaaactgctgagggattggactgtgtcagaactattgaagaattagcaagagtcctcagaaaacattcaggnctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggaatgtctaaatcagattgtatgtttggatcgccctcacctgtcccattgaaaccaactggtttatttgttcaggtaaacctagctcaaacggagaaggaggcgtgtctgtcatctgttcactcaggagctgctccctgagtgctctcagctctgcaccatgtccttgcgctgtgctggcagtgtgggccctccttcctctggctgacctgcagcactcctgtctgtcctgcgcgggtgtggtgcgtggtgaggcttactgggcaccggatggcggggccttgtttcagaactcctgcccatggtcttgcttttcagttaacttgcaaaattctgccacccacatgccttatttcagctctccttggatatggtttcggttttaaggctgtttcagatgctcttcctttcgattttgtaaaccagtctatttcattttttaggcagtgcttttacatgaagacaaaaagaaacaaaaaacaacaatatttttgagtccccagtcagggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagtcatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcaaaatttcaacctgtaaaaaaaaaaacatta

SEQ ID NO: 333985 - DNA, 4247 bp, Homo sapiens
  misc_feature (2170)..(2170): n is a, c, g, or t
  misc_feature (2245)..(2245): n is a, c, g, or t
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaggatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggncttgaaactgctgagggattggactgtgtcagaactattgaagaattagcaagagtcctcagaaaacattcaggnctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagtcatgatgtatgtatttaagccacgttaaaagaaaaaatataactatggaccggtattcagtgaatacagtttcatggtttttaattctttcaaagcacattaattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcaaaatttcaacctgtaaaaaaaaaaacatta

SEQ ID NO: 333986 - DNA, 4613 bp, Homo sapiens
  misc_feature (2170)..(2170): n is a, c, g, or t
  misc_feature (2245)..(2245): n is a, c, g, or t
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaggatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggncttgaaactgctgagggattggactgtgtcagaactattgaagaattagcaagagtcctcagaaaacattcaggnctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggaatgtctaaatcagattgtatgtttggatcgccctcacctgtcccattgaaaccaactggtttatttgttcaggtaaacctagctcaaacggagaaggaggcgtgtctgtcatctgttcactcaggagctgctccctgagtgctctcagctctgcaccatgtccttgcgctgtgctggcagtgtgggccctccttcctctggctgacctgcagcactcctgtctgtcctgcgcgggtgtggtgcgtggtgaggcttactgggcaccggatggcggggccttgtttcagaactcctgcccatggtcttgcttttcagttaacttgcaaaattctgccacccacatgccttatttcagctctccttggatatggtttcggttttaaggctgtttcagatgctcttcctttcgattttgtaaaccagtctatttcattttttaggcagtgcttttacatgaagacaaaaagaaacaaaaaacaacaatatttttgagtccccagtcaggtatgtgggttttaaaaaaaacaaatgtgtgttattttatttactgcatactttaccacatgccttttgagactttttctccaaatatgtgcttttaacagggattggacatcagaatcacttgggggaactttaaaacatatagttgcccatcctctacctttatttcctaaagctaattcttcagtggttaagcatgggcctgtgtgttttgtaaattccaagtgatgtttataccacccatgagtggcaaccagagtcttcaattatttgttccagtcccgtgctttttgttgctgctgtcttgccagcagtgttttctcctcctggagagtatttgccacacacaaagtaaggaaaaaaactaatctctagcctgaactccactgttacctctcagctacttcatttattcattctttcaacaaatagctatccagcctctcccctccctttccaagttcaggacaccagcctcaacactgaagatacagcagtgaacaagcaaagccccttctctcatttactctgcatccttttcagaagaggtagacaataaagagatacagaaataatatgtcatgtggtggcaaatgctaggaagaaataacaaaacaagaaaagggaaagagaatggttggctaaggaggcagcatctctggtaaagtaacatttaagcaaagaatcaaatgaaacaaaggggccagtcgggggaaattggtgttagactggtaaactcagagatggaaacaggtgttgtcctgcagcatcactgaggcagtgtggcaggagtggaacaggattggaaactcgagagacagaagaaatttga

SEQ ID NO: 333987 - DNA, 1278 bp, Homo sapiens
cagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagtccttgtaaagaaaataaaataaagaagcggaaaggtgagcacttt

SEQ ID NO: 333988 - DNA, 379 bp, Homo sapiens
gtgtcctgtgcctgacggtggttttccccctattctctttcaattacaaagtgactcagcactgggcttcgcttccattgttctctgggacctcttccatttatcagcctctgtgcttatcactgtctgtgagtcactctactgatcatttatctcctttcaaagctggcagagtaatgcttcgacgcaatctatccccattagataagattttctgaaatggattcagaatatattaaagcctcatttatctgttattgatgggttagtcaaggatctcacaaagcttcattttccaaataaccaaaacttatcatttaaagaaatagtggctggccgcagaggctcacgcctgtaatcgcagcactttgggaggccg

SEQ ID NO: 333989 - DNA, 733 bp, Homo sapiens
aggagccttgctcatcatctctttccactgcagaaggttttttccaccccactaaatatttaaaattcatattcagtgacagccctttttttactaagttgaagcgttttggtactttcaaaagggctagtctttttgtaaaacatgcattttatttcatctaaaaacttatcttttagtagtaggaaaataataaatgcttattatacaaatttcaaatggcagtaaagagaacaatgcagaaatacaaagtcatccttaattttactccagagacaaccactgtcgaaagattggaggatattcttccagactttattttccacgcgtttagcaatatacaaggcgtgcatcttaaaaatcctaatacagcaaagttaaaattgcacagtgaattctctgtacttatgcaaaggaataaactgcttttctgataagcataaatgacctaattggtctcattcttggcacattgctaatttttgagacatttagaaaacttttaaatgacttgtcctaaaaatatttggcaggacgtatattagaaaactatggagtaaagtgatcagggtgaggtagaatgattcagttgatgattttcagtttattctagggctgggtccacattaatgagggagaaagatggtactgttaatccaaatgatgtgaaaaaagcttcactatgttttatttaaatgctctgtaaagttttacagaaagggttgttctgaag

SEQ ID NO: 333990 - DNA, 970 bp, Homo sapiens
tttttttttcttgaatgtgcttcgcaagccaggctatcttccaaggaaggcagacagtgggagagcagagggactgactgcaggcaagcacattgaagaaagacactggcgggtttccccaccctcaccccaaagcagaaaactagcagacgtcagctcagccccgtcctgggcacagacactacacaaggagacgctggaagttaagcaatactttaatactgtaatatgtttgttttctttttctttcttttttttctaccaaaaaaaagtaagtaaactaaaacacaaaaacatataaataaaatccatccctcttgtcggggacctgcaggggggcaaccttaatccaaacacctggctatcaaataatcagaatgtattgtctcagacaggatttcagttccgggaggcaggggcatgatgggggagggggccggaggctgagagacaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgacctcacccttacttttatactttagtatgaaactgatgagaactttggtagtgagtattttttttatatatatacatatatatgtactatctatatatatatctcaagcatctttcaggtctttgtgtgtggctttcttaaagccctgttgtaaaaaattactatgtggatggcagtctctcacatcacagatgtggaaagtataattttatatttgtattttcaaataaataagtttgtgaaaggtttccatcctctactgtggtccagaaatcaatgtgtttgtctgaca

SEQ ID NO: 333991 - DNA, 1060 bp, Homo sapiens
  misc_feature (1005)..(1005): n is a, c, g, or t
  misc_feature (1007)..(1008): n is a, c, g, or t
  misc_feature (1020)..(1020): n is a, c, g, or t
  misc_feature (1024)..(1024): n is a, c, g, or t
  misc_feature (1030)..(1031): n is a, c, g, or t
  misc_feature (1036)..(1036): n is a, c, g, or t
tttttttttcttgaatgtgcttcgcaagccaggctatcttccaaggaaggcagacagtgggagagcagagggactgactgcaggcaagcacattgaagaaagacactggcgggtttccccaccctcaccccaaagcagaaaactagcagacgtcagctcagccccgtcctgggcacagacactacacaaggagacgctggaagttaagcaatactttaatactgtaatatgtttgttttctttttctttcttttttttctaccaaaaaaaagtaagtaaactaaaacacaaaaacatataaataaaatccatccctcttgtcggggacctgcaggggggcaaccttaatccaaacacctggctatcaaataatcagaatgtattgtctcagacaggatttcagttccgggaggcaggggcatgatgggggagggggccggaggctgagagacaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgacctcacccttacttttatactttagtatgaaactgatgagaactttggtagtgagtattttttttatatatatacatatatatgtactatctatatatatatctcaagcatctttcaggtctttgtgtgtggctttcttaaagccctgttgtaaaaaattactatgtggatggcagtctctcacatcacagatgtggaaagtataattttatatttgtattttcaaataaataagtttgtgaaaggtttccatcctctactgtggtccagaaatcaatgtgtttgtctgacaaaaaaaaaaataaaataaaataaactgttttgacncnnaaaaacacaaanaaanaaacanngaaanaaagcaataaaagcgcgacgacaa

SEQ ID NO: 333992 - DNA, 917 bp, Homo sapiens
tttttttttcttgaatgtgcttcgcaagccaggctatcttccaaggaaggcagacagtgggagagcagagggactgactgcaggcaagcacattgaagaaagacactggcgggtttccccaccctcaccccaaagcagaaaactagcagacgtcagctcagccccgtcctgggcacagacactacacaaggagacgctggaagttaagcaatactttaatactgtaatatgtttgttttctttttctttcttttttttctaccaaaaaaaagtaagtaaactaaaacacaaaaacatataaataaaatccatccctcttgtcggggacctgcaggggggcaaccttaatccaaacacctggctatcaaataatcagaatgtattgtctcagacaggatttcagttccgggaggcaggggcatgatgggggagggggccggaggctgagagacaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaatatgaaactgatgagaactttggtagtgagtattttttttatatatatacatatatatgtactatctatatatatatctcaagcatctttcaggtctttgtgtgtggctttcttaaagccctgttgtaaaaaattactatgtggatggcagtctctcacatcacagatgtggaaagtataattttatatttgtattttcaaataaataagtttgtgaaaggtttccatcctctactgtggtccagaaatcaatgtgtttgtctgaca

SEQ ID NO: 333993 - DNA, 342 bp, Homo sapiens
aaaaaaaaaaataaaataaaataaactgttttgaacagagttgtttggtgttctttcacttgcagaggaggtctggggtctgggagagctgttgttttgcttgggcgggagaggatatcatcaaatcgcacctgccaccctcacccctcagcatgaatgctggccgtgggcctccagcagcgaagaagtccctgccttgtccccagggagcttgtggcaccatttttatgaagtggcaagagagcactaagatggaagagcagacgggagaggggtgtagattaacagcagaaggtacacagaacccatgagtggacagggaataaaccccaaaggtcctgc

SEQ ID NO: 333994 - DNA, 192 bp, Homo sapiens
aattcatagcaggcaattatcaggatataataaaagaggcaaaaagaccacgtagagtgtgtagtgcttgactggttgttgccgttagcggttgtttgatatagaggaaacaagtggagtgttttttctgggataatatgagatactcagcagagaccttatggaaaataaagtctttttagaagagtagtg

SEQ ID NO: 333995 - DNA, 764 bp, Homo sapiens
acatctcatgctcatgaacgggaagaatcaatactgtgaaaatgaccatgctgccccaaagtaatctatacattcagtgcaattcccatcaaaatactatcatcattcttcacagaaccagaaaaacaattctaaaatttatatggaaccccaaaagagcccgcataaccaaagcaataccaagcaaaaagaacaaatctggaggcatcacattacccaacttcaaattatgctacaagttaccaaaacagcctggtactggcatgaaaataggcatgtagaccaatggaacagaatagtgaacccagaaataaagccatatatgtacagccaactgatcttcaacaaagcataaaaaacataaattggggaaaggacatcctattcaataaatggtgctggaaaaaccggcaagccacacgtagaagaatgaaactgtatccccatccctcaccttatacaaaaatcaactcaaaatggatcaaagactaaaatctaagtactgaaaccataaaaattctagaggaagacattgaaaaaactcttctagacattggcttaggcaaagaattcatgactaagatcccaaaagaaaatgcaacaaaaacaaaaataaataaatggaatctaattaaactaaaaaaacttctgcacagcaaaagaaataatcagcagagtaaaaagacaacctacagagtgggagtatatattcacaaactatgcaactgacaaaggactaatatccagaatctacaaggaactca

SEQ ID NO: 333996 - DNA, 6934 bp, Homo sapiens
ttgcaacccatccgttctatctttgtagcctcagctcctaccatagtgcctgtcacggagcagctaatcgacacagtgacgcgtgtaagttatttgaagccacttcctgcgcagtggaacgtccccgccaagtctcccggcactgctgggtgtagtcccaattaaaacactaggtttcaacaacacaaggagggtccgcagggtccccggactacccaccaagggtcggctctgctttgaaacgcagctgcaggaggccgaggagcgccgcgatgccccagttatccaggccattccttccccggccgaagctggccgcctgcatgcacctaaccttgcgctaggcactggctgcggttaatccagcccgcgctcggtcctccgcgatcccagcctcccttgcgccaaggacacgtccggcggcttcgcggggcctgtctacgccaccgcggcgcttttctatgatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaagcagaattacctgattctaggacaaaggaaattgaagccattcatgcaatcttgagatcagagaatgaaaggcttaagaaactttgtactgatctagaagagaaacatgaagcatcagagattcaaataaagcagcaatctacaagttaccgaaatcaacttcaacaaaaagaggtagaaatcagccatcttaaagccagacagattgcactccaggatcagttgctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcagacttccaaagcacaaggaacagataactctgatcaaagtgaaatatgtaaactacaaaatatcattaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctgatgccgaaaatgaaataatgagattgagtagtttaaaccaggataacagtcttgctgaagacaatctgaaacttaaaatgcgtatcgaagttttagaaaaagagaagtcattactgagtcaagaaaaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagctgagatagaagaattggacagacagaatcaagaagctacaaagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaagaggaaaaagctatgtattctgctgaactcgaaaagcaaaaacagcttatagctgaatggaagaaaaacgcagaaaatctggaaggaaaagtgatatcattacaggaatgtttggatgaagcaaatgctgcattggattcagcatcaagacttacagaacagttagatgtaaaagaagaacaaattgaagaacttaaaagacaaaatgagctccgacaagaaatgctggatgatgtacaaaagaaattgatgagcttagcaaacagctcagaaggaaaagtagacaaagtcctaatgagaaacctcttcattggtcatttccacacaccgaaaaatcagcgtcatgaagtgttacggttaatggggagcatcctgggcgtcagaagggaggagatggagcagttgtttcatgacgatcagggcagtgttaccaggtggatgactgggtggcttggaggaggatcaaaaagtgttcccaacacacctttgagaccaaatcagcaatctgtggttaatagttctttttcagaactttttgttaaatttctagaaacagaatctcatccatccattccaccaccaaagctttctgttcatgatatgaaacctctggattcaccaggaagaagaaaaagagatacaaatgcaccagaaagttttaaagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttaga

SEQ ID NO: 333997 - DNA, 7535 bp, Homo sapiens
ttgcaacccatccgttctatctttgtagcctcagctcctaccatagtgcctgtcacggagcagctaatcgacacagtgacgcgtgtaagttatttgaagccacttcctgcgcagtggaacgtccccgccaagtctcccggcactgctgggtgtagtcccaattaaaacactaggtttcaacaacacaaggagggtccgcagggtccccggactacccaccaagggtcggctctgctttgaaacgcagctgcaggaggccgaggagcgccgcgatgccccagttatccaggccattccttccccggccgaagctggccgcctgcatgcacctaaccttgcgctaggcactggctgcggttaatccagcccgcgctcggtcctccgcgatcccagcctcccttgcgccaaggacacgtccggcggcttcgcggggcctgtctacgccaccgcggcgcttttctatgatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaagcagaattacctgattctaggacaaaggaaattgaagccattcatgcaatcttgagatcagagaatgaaaggcttaagaaactttgtactgatctagaagagaaacatgaagcatcagagattcaaataaagcagcaatctacaagttaccgaaatcaacttcaacaaaaagaggtagaaatcagccatcttaaagccagacagattgcactccaggatcagttgctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcagacttccaaagcacaaggaacagataactctgatcaaagtgaaatatgtaaactacaaaatatcattaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctgatgccgaaaatgaaataatgagattgagtagtttaaaccaggataacagtcttgctgaagacaatctgaaacttaaaatgcgtatcgaagttttagaaaaagagaagtcattactgagtcaagaaaaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagctgagatagaagaattggacagacagaatcaagaagctacaaagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaagaggaaaaagctatgtattctgctgaactcgaaaagcaaaaacagcttatagctgaatggaagaaaaacgcagaaaatctggaaggaaaagtgatatcattacaggaatgtttggatgaagcaaatgctgcattggattcagcatcaagacttacagaacagttagatgtaaaagaagaacaaattgaagaacttaaaagacaaaatgagctccgacaagaaatgctggatgatgtacaaaagaaattgatgagcttagcaaacagctcagaaggaaaagtagacaaagtcctaatgagaaacctcttcattggtcatttccacacaccgaaaaatcagcgtcatgaagtgttacggttaatggggagcatcctgggcgtcagaagggaggagatggagcagttgtttcatgacgatcagggcagtgttaccaggtggatgactgggtggcttggaggaggatcaaaaagtgttcccaacacacctttgagaccaaatcagcaatctgtggttaatagttctttttcagaactttttgttaaatttctagaaacagaatctcatccatccattccaccaccaaagctttctgttcatgatatgaaacctctggattcaccaggaagaagaaaaagagatacaaatgcaccagaaagttttaaagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttagaaactgcaggtgtcaggagcaagtgtttgctatataatctgctttattccttctgatttgacctaatttaagctaggaacatttaatttatcttttaccttaatttacaaaaatacagacagacaaaaatactagtagctatatggcagctttttatttccttttgtgatttccaagctcatttaagctagagattgtggtttatcaagagagtgttttttttttttaaacgaagaataaaaaaatactagtagtggcttctctgcatagtgcagaaagttgatttgaagcatatattgatcatctttagaggactttgtggagacaggccaacaagattgttgctggaaggtcataggttccctgatggatcacctgaggtcaggagttcaagaccagcctggccaacatggtgaaaccccatctctactaaaaatacaaaaattagctgggcatggtggcaggcgcctataatcccagctactcaggaggctgaggcaggagaattgcttgaccccgggaagtggaggttgcagttagcaaccactccactgcactccagcctgagcgacagagcgagactctgtctcaaaaaaaaaaaa

SEQ ID NO: 333998 - DNA, 9304 bp, Homo sapiens
ttgcaacccatccgttctatctttgtagcctcagctcctaccatagtgcctgtcacggagcagctaatcgacacagtgacgcgtgtaagttatttgaagccacttcctgcgcagtggaacgtccccgccaagtctcccggcactgctgggtgtagtcccaattaaaacactaggtttcaacaacacaaggagggtccgcagggtccccggactacccaccaagggtcggctctgctttgaaacgcagctgcaggaggccgaggagcgccgcgatgccccagttatccaggccattccttccccggccgaagctggccgcctgcatgcacctaaccttgcgctaggcactggctgcggttaatccagcccgcgctcggtcctccgcgatcccagcctcccttgcgccaaggacacgtccggcggcttcgcggggcctgtctacgccaccgcggcgcttttctatgatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaagcagaattacctgattctaggacaaaggaaattgaagccattcatgcaatcttgagatcagagaatgaaaggcttaagaaactttgtactgatctagaagagaaacatgaagcatcagagattcaaataaagcagcaatctacaagttaccgaaatcaacttcaacaaaaagaggtagaaatcagccatcttaaagccagacagattgcactccaggatcagttgctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcagacttccaaagcacaaggaacagataactctgatcaaagtgaaatatgtaaactacaaaatatcattaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctgatgccgaaaatgaaataatgagattgagtagtttaaaccaggataacagtcttgctgaagacaatctgaaacttaaaatgcgtatcgaagttttagaaaaagagaagtcattactgagtcaagaaaaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagctgagatagaagaattggacagacagaatcaagaagctacaaagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaagaggaaaaagctatgtattctgctgaactcgaaaagcaaaaacagcttatagctgaatggaagaaaaacgcagaaaatctggaaggaaaagtgatatcattacaggaatgtttggatgaagcaaatgctgcattggattcagcatcaagacttacagaacagttagatgtaaaagaagaacaaattgaagaacttaaaagacaaaatgagctccgacaagaaatgctggatgatgtacaaaagaaattgatgagcttagcaaacagctcagaaggaaaagtagacaaagtcctaatgagaaacctcttcattggtcatttccacacaccgaaaaatcagcgtcatgaagtgttacggttaatggggagcatcctgggcgtcagaagggaggagatggagcagttgtttcatgacgatcagggcagtgttaccaggtggatgactgggtggcttggaggaggatcaaaaagtgttcccaacacacctttgagaccaaatcagcaatctgtggttaatagttctttttcagaactttttgttaaatttctagaaacagaatctcatccatccattccaccaccaaagctttctgttcatgatatgaaacctctggattcaccaggaagaagaaaaagagatacaaatgcaccagaaagttttaaagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttagaaactgcaggtgtcaggagcaagtgtttgctatataatctgctttattccttctgatttgacctaatttaagctaggaacatttaatttatcttttaccttaatttacaaaaatacagacagacaaaaatactagtagctatatggcagctttttatttccttttgtgatttccaagctcatttaagctagagattgtggtttatcaagagagtgttttttttttttaaacgaagaataaaaaaatactagtagtggcttctctgcatagtgcagaaagttgatttgaagcatatattgatcatctttagaggactttgtggagacaggccaacaagattgttgctggaaggtcataggttccctgaggtgaagtatgtatttggtcctgtgcaatattatcatgtgtgtagattctttttttgtttgttttaaatagagatggggtctcactatgttgccaggctggcctcaaactcctgggctcaagtgatcctcccacctcagcctcccaaagtgctgggattaaggcatgagcacactgcgcctggccctgtgtgtaaattcatgtgactaccaccacaggcaagacacggaagacttccattacaagcatccccctgtgttgccctctcataatcattgccacctctctccctggccctctccttaatccctgacaaccacttactgttctccatctcagtcattttgttattttgagaatgttatataaatggaatcaatatataccctcttgagactggctttttttcactcagcataattcccttgagatccatccaaggctttggatgtatcactagtttgttcctttttattgttgagcatatagtgcagatatatcacttagttttaacagctaaggtatctatttaaagatatcatcttaaaactaaatgttacacaaattcatgcaactttcatataagcattaaaccatacagctgcatctacgtaagtataattagcaaaatcactgaacatgccacttcctgcctccgtctgcggtgttgacatatgaggtacagcaatccgagagtcaactgttatcacggtggccactgagggcagtgaaatcactttgatagcaccagtacccagatgtttgaaacttaagaaagtatttctttaatttttcataaacccatcataaaaaaaaaaatcccgacttgaaacttaactgtatctggatgttcatatttttattagttgttgaagttgtacatttaaaaagatatttcttgcaaattttgtaaatttctatatgcttttaaaatagaaacatttgtataacaaggaaggatgaaaataaaacaaattcaaatatgtgaatagtcctggctgaggccagaactaaatttggttatttgcaagttttactgtgattaactgtactttctaatgtatttggaagactggaagtcttaattccatgttgatgggtgaaacttgtttttctgaaaaatgaagtaactgaaaatgctgcttcagaatgtcttgtatctccttagataactaatttatattgccattctttatttactatactttaaaggaagttgtcatgcaagttctatattagaactgtcaaactgcctcttggtttttgcctattattatttctctgtgagttgttactccttggtttttatatgctcctaacaaagatactttcactgactatcctacattatttgctgcttgccattgaaatttcatttcagtgtggagaaatgaaatactagtttctaagttaaaaaagacacatggtcctttatttttaagaaatagaatatgtaaaaagttttctcttttaatttgaaaaagagatgcatggttggtatttaagtagtatgtcatcatatttgaaatgccttttgtgacatttttgagtatttccttctctgaccaaaacaacttgtccgcctctcatcccatggtttaacgtaagtttaaaagctgttgtgggtggattgcatagctaaacatcacagagcatgatattaaatggctgctatttaaataaatatgtgaccttgtcctaaagctataatactggccgggcacagtggctcacgcctgtaatcccagaactttgggagggtgaggtgggtggatcacctgaggtcaggagttcaagaccagcctggccaacatggtgaaaccccatctctactaaaaatacaaaaattagctgggcatggtggcaggcgcctataatcccagctactcaggaggctgaggcaggagaattgcttgaccccgggaagtggaggttgcagttagcaaccactccactgcactccagcctgagcgacagagcgagactctgtctcaaaaaaaaaaaa

SEQ ID NO: 333999 - DNA, 1406 bp, Homo sapiens
ttgcaacccatccgttctatctttgtagcctcagctcctaccatagtgcctgtcacggagcagctaatcgacacagtgacgcgtgtaagttatttgaagccacttcctgcgcagtggaacgtccccgccaagtctcccggcactgctgggtgtagtcccaattaaaacactaggtttcaacaacacaaggagggtccgcagggtccccggactacccaccaagggtcggctctgctttgaaacgcagctgcaggaggccgaggagcgccgcgatgccccagttatccaggccattccttccccggccgaagctggccgcctgcatgcacctaaccttgcgctaggcactggctgcggttaatccagcccgcgctcggtcctccgcgatcccagcctcccttgcgccaaggacacgtccggcggcttcgcggggcctgtctacgccaccgcggcgcttttctatgatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaagcagaattacctgattctaggacaaaggaaattgaagccattcatgcaatcttgagatcagagttgcctttgtgtacacacctgctttcagccttctacatatgaacatatcaagtaaatgttggtgtacaaatatacatgatgaaagaatactgtcacatggccaggcatggtggctcacgcctgtaatcccagcactttgggaggccgaggtgggtggatcacctgagttcgagaccagcctgaccaacatggagaaaccctgtctctactaaaaatacaaaattcgctgggcgtggtggcacatgcctgtaatcccagctacttgggaggctgaggcaggagaatcacttgaacctgggaggtagaggttgcggtgagccaagatcccaccattgcactccagcctgggcaacaagagcgagactctc

SEQ ID NO: 334000 - DNA, 382 bp, Homo sapiens
ggtggtatcataagaggggagagtcagaatcacctggggaagagttttttccaaatcacaatgatcctccaaaacctagctcaggaactccatttttcagaaaactctgcctgatgatcacctcccccatgccttccaaggggtctaggcctgagacttacagcatctaaggatgactctattagtttggatactagttcaggtgctttaacaaattagtaagagtggcttacactgagcacagtgactcatgcctacaatcccagcactttgggaggctggggtgagtggattacttgagcccaggagttcaagaccagcctgggcaacatagtgagaccccatctctacaaaaaataaaagaaaaattagccaggctttg

SEQ ID NO: 334001 - DNA, 191 bp, Homo sapiens
caatagcactaaaagggtgtgtacaaaatgcagtggctgactaaccatctcctccattgctccgcctaagagacacccacttttagctgttttctttaggaacttgttaatattaggtttctaaaaacatgtaaccatgtgaatgagcttagacttactggattcctatcataataggcggggccttagtt

SEQ ID NO: 334002 - DNA, 154 bp, Homo sapiens
atgacattggagtggggtttagtgatcattgtgaagtgcttggactctgtcttaagagcagtggcctagtttccccaaaacacaacttatattattcatatttttaataagtagagcattggaaatggtgctttattatggatttactctgcat

SEQ ID NO: 334003 - DNA, 1019 bp, Homo sapiens
tattttctctaattgaatgttctctttatttaagcattgtagagactgaggttcaaaggttattttctcaaagttacagcagcctctgaggtggtggagggtggcagcaggacagtgagctgacggccaacccctgtgcccaagtgtgctgctccgctcaactccatgtgcaccagggaacagccattctctgcaggctgatttgatctggaaccacaattgagtctagttctggaatctcagacacatggagaattacaccttgtctccagttgctacaagtcaagtccacctgcatgcagacagctacaattgtcttgtaaaattagaaaacagaacagggacaacagtattatctatattgactatagattaattattcatttgcattctttgtcttttgtacttataaatatgaaatttgtatataaacgtgtgttttacaacataagatacagatctatatatatgtacctttgaaagattattctctctgctctttggcctaaatttccaaatggaatcatcctgtgtacagtaacctgtgtctgaaaatttctgtccacttagagtaatgaaggcatggggtcataatgagagcaacaaaaaagttacactttatactgtgaaagaccgtcaccttattgttcatttacttaagtttttcattttgtttttatattttgaaatgttgaataaaaaactcaaggcaaaaaaaaaaaaacaaaaaaaaaaaaaaaaaaaaaaaaaaaaaaaaacaaaaaaaaaaaaaaaaaaaaacaaaaaaaaaaaaaaaaaaaaaaaaaaaaaaaaaaaaaaaaaaaaaaaaaaaaagcaaaaaaacaaaagaaaaaagaaagaaagtcggggcggcggcggagcaacaacaacaaaaaagaaaaccagaggagcgggcacggaggacggcacaagcatcgcgacacagacgaaggggaagaagggatggcgcaatagataagaaggggaggcaaggaggagccagagagagaaacgagaga

SEQ ID NO: 334004 - DNA, 275 bp, Homo sapiens
ctcggcttcccagagtgctgggattacaggcgtgagccaccgtatttgagcaggaatataaaaatgtgaatttaaacaacttcattgtggtggtggtagtggtcattgtctttgttttgtttgttttaattggcatagtcaagtcttcagctgagcaactggtcttaggtatggctggcccaagtgacaactcaggccaagatagaagtgagaagttggaacagggttgtttactgtggaggatgagtcagagctgagccctttaagagaggatg

SEQ ID NO: 334005 - DNA, 496 bp, Homo sapiens
gatgacaagaaaaaacaacatgtacatgttcagtacagacaatatgttttggaatattttccaccctaggttggtgaaatccatggatgtggaacccacagatacagagggccaactgtatgtggcatcggaactaaagttttaaagtcctttctgggcattgttgagcatagcagtgttgaagttgtgcagtttagtcactgtagccttcactctgcatcgatgaatgagagaggggagatggagaagatcacctcttctcacagcacacaaattttatgtttgtctcattgcagtgtagaaggtattctgttcctcctggggcttctgagctgtgggtcaggaaacagctctaacgaagatatttattgggtgtttactctgccccattccttaagctcccttctcccctccattcaaagtgcctatacccacaggcatgcagtccctggccatcctcagagggtctgagtcagggattgcttctccgtttctc

SEQ ID NO: 334006 - DNA, 450 bp, Homo sapiens
gtgcaaaatctgctttggtcaaaagacagcaagatgggggatgagaagcttcgactcatgctagaatggtgttttccatagcatgccccttggaaccctaattccctgaaatatctgggctggggtggagctgcggaggttgagaagctcttcaaacagtggcgcagtcaaggtcaaatccatctggaaggtgctacatattcccctttccctcattgagacacaaaacacacaacaggacacttgagtctctggcagatccggaaacctgaaagctgttttgctcctacgagccttgggtccccaaaacaacatttagccacagatttgccaaatgttttgagaatgttttcctaaaaatttgccaaatttttgagaaaattcagtgagcctgacaaattaataatactaatactagtaataatagttgctaagtcttttttttttttt

SEQ ID NO: 334007 - DNA, 120 bp, Homo sapiens
cattacggtgggccttataaaaggggtgatttggacacagacacacgcgtgtgaagatggaaggagagatgggagcaatgcctctccaagccaaggatggtcaagagcagctggcagccc

SEQ ID NO: 334008 - DNA, 449 bp, Homo sapiens
cttgccccgccacggtgacttaacgcctgtagtcccagcactctgggaggcggaggtgggaggatagcttgaggccaggaattcgaggctgtgagctgtgattgcactactgcattccagcctggttgacagagagagaccctgtctcaaaagaaaaggaatccttgtcacttttatgtaaagatgtttaaaacacaaagtatctcaatgcaaagaaataatacatgtttgatataagcctgggcaacatggcgaaacctcgtctctaccaaaaatacaaaacttatccggggatggtggtgcatgcctgtgcttccatctatctattccgggagctgaccaagaagatcccttgagtctgggaggtcgaggctgcagtgagctgtgatcgcgccactgcactccagcctgggcaatacagcaaggtcctgtctccagaaaaaaaaaaa

SEQ ID NO: 334009 - DNA, 120 bp, Homo sapiens
cctcagtcttaacctttcctcaaagtagccaaggacagtgtatcagatcaaacactcctcacttaacaatatacacatataattagtatctgtgtggctgcatctgggtggctcccctgg

SEQ ID NO: 334010 - DNA, 225 bp, Homo sapiens
gttcccggaacccaaactcaattgagcaggattatgtaccatcaaaatcagtgggaattcccagcacactacagaaggtaacttctccttcaacagggttgttcgaaagcctgcaaggatgagctttttattggaggactcttccctgggtaactgaagtggaaatacagtaagaataaatgccttgatttggctgaaaagggttcaaaaacataaagaattggg

SEQ ID NO: 334011 - DNA, 321 bp, Homo sapiens
caatatttctcccaaatctgatttataattttctttaaggagtcttcgtagtaatcccatctggccccatttttcaacagtacttttgaaccaagcttctactattattattttcatgttgatttattaaagttttttaaaaaattgtattatgtctgttctttttttcccaagtagatatcagtgtgatggaaacactatcttctatatcttttgactggagtcttttatacttctgagtacatgatagatgttaaatatatactctgttaatacatattagcaagtttaaaatggtggctgtttgtttaagtcacataa

SEQ ID NO: 334012 - DNA, 300 bp, Homo sapiens
aggacctgcctccctctgcggcagcatcttcctccacatcacatcacataccctgcttgctgggcctggccaaggcctcttctacccagtcctctccttcagctagatgccacggtaggaaagcatccagagtgtcgcctgataacatctgaacgatgtcctaaaactggcaaatccccaaaggccaacaagactcgtctctaggttctggggacaggccagttgatgggaaagatggatttggaggcagagtctcctggcatccctgatgctctgctccatggaagtcactccccagaa

SEQ ID NO: 334013 - DNA, 173 bp, Homo sapiens
aaaggacagggtgggggctggagtgggggccaagacggcaagccaaacaggagatgagggggagccgggagatgaagtatcagggacaccactaagggaagtcagcaaggtgctggaagggcaagaggtctcactgtgcctgggggaagggggtccctgggcatcagtccccc

SEQ ID NO: 334014 - DNA, 430 bp, Homo sapiens
tgatacacctgtatgcttaaaggctaatgagacccacttttttgtctgcccagaagataagtagtatagtcaggtctcatacttttatgctgattgttttcatgcttttcaagtttttattaatgcctgtggctgtactccttatgagtgtaggagagatttactgtgtaagagagatttactgtggtgaacccagctttttttatacctagaatactttggagacttgtaagcctaccattatctactaaagaatactaattggggccagaggtccgtaaagaatggggattacgtacagatgaaaattaggtattttcagctctagttgagggtacagggataggggacaatgcaactaggctgtggttggggcatccattccttgcagtgatggtactcagcccttgtccctgagcttgctgcttcc

SEQ ID NO: 334015 - DNA, 814 bp, Homo sapiens
ttatcgaagatgactgcaagtctggcctctctcaacccaaggagccaaggaggggaaggccggcctgagcagcaacgtagacaagagctcaggagggcagggacagagccctggcttcagcaagagcgtggggaacagagggcaagggggtccatgcagcccaggatggcagggtgctcatacacacagccttggtcctgtcccctctcccattgccgcttttgagctcaccttgtttaaggccaaagcacacaccatcctcccacagagccactaatgcaattaacaaaacacattcataaatcttgcatggcgtccggagctgtctcctctccctaagcacaaaggccagctccagagatgctgtgcagagagctgtctgacctctccagcgtcagggccccctgaaaagtgcagcataacccttagtaggacagaaagaccattgtcttctgccaaccattacaaagtggagtggggctggggttaggaaacacagacaaatcagaagaggctgagaaggcggagatgaaagtgcataggtgtttgcagggagctggggaatagttcgtgccttccaagctcaacaagagagcattcagcagagaccagagaatcaccacttttggagggtgattttaccttgtgagaacagagcacagggtgtgtgggacccagggcatcttcggcaatgcgggcgtgacttggcgggatgtcggtgtttgtgtttgcatgtgtgtgtgcgtgcgtgcatgctcagtctggaaaactggtgactcactaaaacaccgagctttctgatctgaagagctta

SEQ ID NO: 334016 - DNA, 6416 bp, Homo sapiens
  misc_feature (113)..(113): n is a, c, g, or t
  misc_feature (117)..(117): n is a, c, g, or t
  misc_feature (122)..(122): n is a, c, g, or t
  misc_feature (129)..(129): n is a, c, g, or t
  misc_feature (136)..(136): n is a, c, g, or t
  misc_feature (145)..(145): n is a, c, g, or t
  misc_feature (149)..(149): n is a, c, g, or t
  misc_feature (1034)..(1034): n is a, c, g, or t
  misc_feature (1271)..(1271): n is a, c, g, or t
  misc_feature (2761)..(2761): n is a, c, g, or t
ctttgagacagttttgctccgtcccccaggctggagtgcagtgatgctgtcatagctcactgcagccttgaactgctggtctcaagcaatcctcccgccccagcctccagagnagcncgganttcaggngtgcacngccttgccnggcnaatttttttttttttttgagacagagtcttgctcagttgtccaggctggattcaagaccagcctggccaagatggtgacacctcgtctctactaaaaatacaaaaattatctgggcgtggtggtgggcgcccataatcccagctactcaggaggttgaggcaggagaattgcttgaacctgggaggcggaggttgcaatgagcctagatcacgccaccacactccagcctgggcgacagagtgagactccgtctaaaaaaaaaagaaaaatatactatctaatacatatagcatacaaaatatatgttcatggactgttgatgttatctgtaaggcttcccatcaacaataagctattagtggttaagcttttggggagtcaaaaattatatgcagattttctactgcatggcggggcagcattcctaatccctgtggtattcaagggttaactgtatttcttggtgaccttggacaaattgttgaacttctctgtaccgtggtgtccgaagtaaagtagtccattcaggcacagtgctaggacaccacctggcctatagcatgtgctcggtcaaagttaactctactgtaattcctgcttgggttgttctggggatacctaatttctccccaccagccacttccccaagaatagtgagtgtgagggtccttacagacagggagatgagagcgtcactcctctttatgaccgtcaaagctctgcaggtgctcgcccttcgggtctctccagcctcacctggtacccctctcccccttgcttgctttctgcagccatggtggccttttattcctcagacccgttttctttcctgtcccaggaagggcctttgcaggtgctcttcccacagcctgaaagttcctcgngtagctggctcttcctcaccctccaggcctccaggcctcagttcaaatgcctctccctgggagaggctggtcctgaccaccaccgcctcctgcctaaacacagcagattctctctcccctctagaatccaaacaccaggggagcaagagtagagttggtttcattcaccccgggctctccaagcatagcaaacgctctggaagcacgtgatgagtggctgggtgacgaagagctacnacccgagacatggtacccacatgggtacccaccctatgggtagacacgagcctggtgtcaggaggaactgggtttgaatccttcaacaactgtgtggcctttcctctctctgagcgtcgatgtccttattcgtagagtggatgatcataccttccttgcagagccattgcacagatagtgacataggcacacacaatacagtcctggctcacgctcaggagacagtggctgtcaagtcaggagcccgtcctgcagcagcctagccatctggaaggatcactcctcgacatgccgtcaatgcctggcacttggtaagaatgagtttctcacatttctctgaagggatggggtggggggcaggtagagaagaaggctctgggcacctagggtgggaaggaagaagagagagactggccctgagggtagccagtgcctctttgttcattttctcaccagaataacaggggaaatataccatttagaaagaggcagtgaggattaaatgagctagcatatccagcacatagaaggccctctccccatcctcgtccctgaaagcaaactcctcgatttctcagttttgctctggttcccaggctgtgcatggaggcaaacacagggcccttcactcaggccaagctcaggagagcccaggctgcaccgagtccacactctcggctcatttccctcagtccaccaagaggatgacaccaaggccccctcctgtacccctgcctctgccccagcaagtcctactgagatcctgcctgttatgaaatggggctgtcccattgggtgcagggcagatggcaccatgcctctaggagcctcagcatgtgtttccaaggagacagccgtgtgtgtgtgtgtacacaccaacttgtaccatccagttcttcaaaggaaggtggaaagaagggaatgagggtcaggttgcaaatgggatgtaggtggaagacgcacgacgccaggccatgctgctgtttgcctttcacagaaaaaaccagcacagcatctcacggtttgcagacactttcacatgggataactcacttaatcttggcaacaagctcatggcacagatattcttttccgctttttaaagtctggagatggagagagaggggggcaagtcccagccagtgggttgtagaattaggatttgtggcctgactctgatcataagccccctgctctcttcccagggccacactgccttgcctagaaaggattctagatcaggagtgcccctacgtggggatgccgcctgcccagcccaaagcaaaggccttgttcagcctttgaggtgtatgttccggcttcacaactccctgaaacggaggcctgagtgaccggagatggcaagaaaatgggaggaggtgtctctaagcatggccagggccccatgggagagggaagtatagggtataaaatgctaatcatatgatttagagacacagtgtctttccagaagctggaagagaaagacnttaagagctggagtgagcagtctggaacagaatcaactcttggaaaagtatccttgggagacaggttgggagtgaagacaggaagagtggttttcaggatttagggcccagggacatagaggggaaactgagtcagggcttggctacagacccacccttttgctggaaatggatttctctgccaaaagagaaattgtttgaactcatggcctagagtgaaggccaccaagaagccattgtcgttggaagccaagggagtctgggagctggtcagctctggtggagaaagtctgtttatccagggacaggaaagaggcaaggtctacacgggctgggctgggaggcccaggggcagcacgagggagagggaccccaagtctgggtttcaaggggcatcaatgaactagaaaacggaatgaggctgggtgcagtggctcacgcctgtaatcccagcactttgggaggctgaggcagctggatcactggaggtcaggagtttgagaccagcctggccaacatggtgaaacctgtctctactaaaaatacaaaaattagccgggcgtggtggcgggtgcctgtaatcctagctactcaggagactgaggcaggagaattgcttgaacacgggaggtggaggttacagtgagctgacgttgcaccactgcactccagcctgggcaacagagtgagacactggctcaaaaaaaaaaaaaaaaatgccaggcgcagtggtttacacctgtaatcccagcacttcgggaggctgaggcgggcggatcatgaggtcaagagataaagaccatcttggccaacatggtgaaaccccatctgtactaaaaatacaaaaattagcctggcgtggtggcgggcgcctgtagtcccagctactcgggtagctgaggcaggagaattgcttgaacccaggaggcagaggttgcagtgagccgagatagcaccactgcactccagcctggcgatagagcaagactcttatctcaaaaaaaaaaaagggggaaagagaaaataaaagaaagtggagtgagaggctgcacggagcggagagcatggggagagcacacctggagtttctcacactccgcagactttcctgtacacttccctcccactggaggtgagatacgctctgcacatgacctaaatgtgtgccgaagcacagccattgggcaggagaaagaagagaaaatggggagtttgtaaacagtcatccaaagagataactgcccccttccactggacgggagcagcaggaagtccaccaaagcaagggcacgcggacctgagggcatccctgttttctggagcacctggcctctgttgtctttctccaattcacacccagagtcagagcagtggcagatggaagagaagccacttcaacaactacttaagtacatggtccctgatggcaagtaattctgtaatcattctgtgtggtggctataccctcttttcaacaaggtctattgcttttcaggtagacgtttctgtttataaatggtctggagattcgggcagctttgggaaactgattgcagattagggggcagtaatgtgctgcagtcattgtgagtcctgtggctcttcagccctcttcccctcattttatctagcagttggctgctggcatctgtcggtcctgtgggacctcatgcttctcactctcagtgagatgccacatgaagtgacaggaggtgacccaagactggcccacaccccttggacctgcccagccatgctggactaactaattctcggccacagcttgccagtgctcggcaaagctctgcctgaaaccttgggcggtcccctatgtgccaggccctgactttgctcatccacagtgagggagggggacttttcggctattgcagggccccacagaccagctgggagccagagaccggcagctgctgccacacttcaaaggccttgttatcctcatctgaggagcagtgccccgagtcgcccctgagaatcctccctgccccactggcagcctcgcccttcatgtgtgtgctggggggcatcctgggacaccttgggggagccaggagggactgtaccacccttcctgggttcctggaccaaggaggggaccctctaccttagcttttggaaatgtgttcagctctgcccacccacacaggccactcagagatgccaaaaaagtcagctgtggcttgtttgtgggtgtggactccaaatgggggcagatccctccggctgagttgcagagggcttcgctgaggaggtgggcttctcatggtgagcaactggtgtccccagtgctaggaggccacaggagcgccttctgtgacactcttctcagagggtggcctggactgtcccaccatttgacagcatggagtgtggtcggaggggcctgagcccagagctgcgtgcgagagctccggagcccctgccctaagctcccagtacgtccttccccgttcgggcaatgtctccctggggctagaacctgctgaccctcctttcctggcttagcccaagcaaacccacacccagttccagaggggtgaagggaggccgggggctgtgggatctgtctcctggctctggtttgggagtgggctgagagcgtcctgtggaaggaaggagtcctgcggggacaaccagggccacctggtgatgctaggtagcaggtgctggcacagcaggatgagagggaggcctgagaaaggtcccctgagaggacaccccaggtgctcaagtcagactcaggcagcaaaagccagctgggcccctctaaaggcaaggaggagttggagccctggggacctgggggtgacctctgacttctgggaacagaagagatttggagagagatttatcagtattctccgccaaactaatctggccatggggttcccaggcaggacttgggagacacctggtgctggccaccaggtctgcccctcagtccacgccctcctctctcctccctcgcgcgttttgcctgtggtatcctaggaacgcagggcttcgagccttgtggtcctgttacataacagtttccatcccatccatgagttcagccctccggcaagcgggagctgcagcaggcgcaccaaggaaagcctctgcttcagacccaggctcctgctgcccaaatccacagtccctgccgctcctctgccacccccagcgtacagggggagggagcttcaaaagcagtcagcatccagccagattctttcaataggaccccctgtcctgtcctggtcccacatgagcacagcacctgtcagtggccacacactggccatggcttccccaaatccagcaggcctaggagagagtcccagagccggtgtgacacatgcctcctcgaacccctctccgcactctgcaccctgagaccaagggcgcaccactgctgagaccctccctggcttggagatgcctgtcctgccactgtgcctgtggctgccccctcgccccctcgagtacctgggcagccaatcaatgcaggtcacctgtgctcctacctgttctcttctctggccaaggcagagagtgctccagcagggacttgaggacctcaggcatgtccatggcaggggccactgagaaccagtcgcagctcacacagcccagcaggaggtgcttgctc

SEQ ID NO: 334017 - DNA, 121 bp, Homo sapiens
tcatgataagggaattcccaataaatacatcgtagaatcagaagattgattttaaacagtgcagacacttgatctgggtagctaaaggcaagaaaaatcccccgcctacccccgccaaaaa

SEQ ID NO: 334018 - DNA, 417 bp, Homo sapiens
tttgtctaacagaattgtaaaacaattactttgtgcgtgcatccaggagcccctcggcattgtgactattttaaattcaaactcaagagtggaatggaggcatgtaaatctctactaacaaatcctcggggatgaaatatttactttctcttctacttcagatctataaaaacagctgacttacaatgatttaatcagaataaatctagccctgatattagactcgtttgtatctatgacatggaattcttacctttggcctcccagagaacttaaaactatttcctgtgactaaatattcaattcaaattcacaaaatgaaaaaaaaaaaagttaaaatgagacgaacctgcacaaaagtagttgattcattcttcccaaaagagcacccattacaataaaaaataaataaataaa

SEQ ID NO: 334019 - DNA, 262 bp, Homo sapiens
agcgaaactccgtctcaaaaaaaaaaaatatatatatacatagtatagctacgtaacagtatatgtatatatttgtcaccacacatatacaacagcaaaagcactggagtctctgatttttagttcaactggcaagtttaatgtacaaagtaggtcataccattaattagcctgtgcttctaaaacattatagatttaggagaaaatgtaactgccaattttcaagcaaattacaaaattatttttccacatggattttttt

SEQ ID NO: 334020 - DNA, 463 bp, Homo sapiens
ggcttggcgacttccccctttcaatggcctagatgcagagagagatcagatacaattttgggatggggaaattttcagttcttccactgtagctggctccatttgtgtgctgtggaaatacaatattttataaagctgtgtgagaatttttgtttgcatttgggcctatatataataatagaattaattaaaactattttaaaagacccaggaaaggtctttaatactttaaagtattttccatctttttttttttctaccccacatgagaacttactaaaatcaacgctaagctttctttttggataaacaatgtaactccacttagtagatagtatgtccttttttcctttttctagtcacacctttataatgtgtatttattatttacaaaagtaaaccattaatattttagatataatgtatgtgttcattttgatagtcctgaattttgactttatta

SEQ ID NO: 334021 - DNA, 452 bp, Homo sapiens
ggcagacacagcctaaccaaggcacacatctgaagtcagtgcccagtatgattggcacagtcaaggttgcccgagagatatccttgaaaaatccctcagaagatcacatgggggatcaacataacatctcacagcaagtccaacagaacgatttcttcccctctagcactggaatggaattcttgtttctttgagttccaaattaggagtcagtttctttttctttttaaacactgaaactcacactcaacgcagtgagaggttcattagggagtggaacatgatggagacaggtgaaagccattctcagttggggcacagggagagcagcgccagctgcacaggcagctgaagccatccccgccaagcatggatggaggtcaccacactcctggaaacggcacgcccgcccacgggaaatgcagacaacagcaacaaggaaacaaaaaggc

SEQ ID NO: 334022 - DNA, 554 bp, Homo sapiens
tatcctaaacaagcaggcacaaagagaagcaggtatccccatgagagattttcagtttctgtaaacaaagtgactgcctgtctgaaaggaataatatcattgcttggggagcacattcccttcccatttgagcaagtaatcaatgctgaagtcttttttgagtacctactatgtgcttgatgccattctggtgctgagaaagggaatggataagtgaatgtggcaaacagaaaaaggacaaaatagcctctactattcagagtctagttgagaagtcagcgtaacagcgaaaaagtgagccagtgactggccacgctgctgggcacagaaacgggcagtcagtagggactgggctttttggaaggctgagaaagattctgctggactctgcagatccctggcaggatgaactgatagaacacttgccccccaggccgctgatgtgggatggcagaagatggctggacaggctcacttgagctgttaaatgcctgcggcccaacacgagctggggcctaggagtcacaccccagaatttcactgtcgtgtttcca

SEQ ID NO: 334023 - DNA, 273 bp, Homo sapiens
ttatccccaacacgccacatgtcatcaccatacttttctctgttgaatatgtttttctttcttctgccttaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgttgggcgataacatca

SEQ ID NO: 334024 - DNA, 341 bp, Homo sapiens
gaccagtggggagtagaacataaaagcagacataccttcatgcccagagaggtgaagcaacttgctataattcataaggatgatttgtagaagaacaggactttggccagatgccctgactcccagagtactggcctttctttctgcttttgacctccaaacaactctccttttcaccattgctaacatgtttagcgcatttccaattacgtagcactgctctagagtttatatcagtcattaaacacccacacctgcatgcagaactatggcaaagaagcacacttttgaaattccttattttaggcatgtcttgctggtagccttaattatgagagaaa

SEQ ID NO: 334025 - DNA, 251 bp, Homo sapiens
ccatctcccatataccatatagtgataggattatccctatttatactttattagaggcattaaaaattgctaaatgcaatagtcatttgttgagctagtcctgtgtgtaggttctctattaagcactttatgtataaggatttaatgagatgaatgcaacgtaggtaagttatttgttcaaagtaacaaagctttttaagtggcagatcttggattcatatccagttctgtggaacgcctacctttggtgg

SEQ ID NO: 334026 - DNA, 376 bp, Homo sapiens
tggagaactcaaggatatgactggagaccccagttcacctctttgtgtagatggtgcagaccccagcccaaggaggcctaaccagaggggtttccatggagccaacatctccagcggagatgcagaaagcaacagtccaaagaaagggtgttgcatatatgggaagagggcaagaaagtggctaatgcctttgctctcccatctctccagctgccaccaagctatgaggaagccataaggtcactgcctccaccaccggccagctgtggctctactcagtcatcccaggaagcagccacctgccctgctcaggggaacaccacagtgtaggagggagcaaccacctctgtcctgcccttcccctttctccaggaga

SEQ ID NO: 334027 - DNA, 533 bp, Homo sapiens
gaacagaaataggagaattactgacttaagtaaacattaagaaaagaatcaaaaggatcattttagaaaatggcagatgggaaagccagtttgcaaaacattaaggagtgactggctgccggggaattggtgaggttaaaaaccaacagcgcttttgtgagatcttagggtgaaactgagagagaaatggaaaagcagcatgacccatcttatttggttatcaattcaacactttcatgtacatgaagcaatttatttagccaaaacattaaataaatcatctgggggagctttataatttaaattatatctgcatttaacacattacggatgaaaaaaagtctgtgtttctttccaaatctgaatgagatatactgtccccttccagactttatactgaaggactaagaaaccagtctcatggtgggtgcccaaaatgacattacatgaagaggctgaagcatgtgaagtagtgagagaaacttgattcttcttggtatttctacatagccccccaaaagcctgcaacttca

SEQ ID NO: 334028 - DNA, 365 bp, Homo sapiens
agataatgttacaaactttttcatttcttacttttgaataatctttagagttcaaagtatgcatgcacgtgaaagttcttgaaacaacccttccttcgtgttggtgttattatcattaccactgtatatatggagaacctgaggttcagagaggtttagtggcttaccccaggtgtcagagagtgagccacatttgtgtgtgcctgttgggtttcacccactgggtaagccctgaaaatagggagacggataaaatgtggccactagcacaaatgcctcaatccttctcgaacctgagtctccctcttctataattttaagttctttttctgcttgttctgggaaggccgtggcaagccatgaac

SEQ ID NO: 334029 - DNA, 296 bp, Homo sapiens
gcccagatcaaatcccatctccccaaaagagccatcccagcatgaagtgacctctgcttctctgagcttctctaaacttttctaacaccattcatttgaatattaattacaacttcgtgacattttaaatgttgatatgtgctattctgtaaatcttaacacttttcatgtgattatttggcaaacaagcaaatggatggttccttatagctttattatatttgcaaactcctctagtgcaaggatcaaaccttatatttcctggcacccccagagtacttgaccaagtgccttcc

SEQ ID NO: 334030 - DNA, 285 bp, Homo sapiens
cggtctgacttgcggggatgagaagatgactatgaccgaagtaaattgagctgggtaaaaagtaaaaattgagatggataagatttcaccaaaagcagggaagggcattctgaacagagggaatgagacagacaaaagcactgtgataagacaatgtttagggaatcttcaaataatcatatgtggatggactacaaaatggagctttttaattaggaccatgacatgattaaatctgtgtcatagaatgttaactctagtgtcatttagaaatttgtactggaa

SEQ ID NO: 334031 - DNA, 196 bp, Homo sapiens
gcagcggtcccaagtgaggctcataagtgctccagcaggcagaggaagggtggtctggagcagcttggaggaggatctaagagtctctggattggtgaaatcataggtcctcctcaggcgaagccttcactttagagtgtctgattgggatggagaaggggaagtacgtgtattaagggaagttgtcaagatcagg

SEQ ID NO: 334032 - DNA, 376 bp, Homo sapiens
gcctcaacttggcttattctgccattaatacttgcaattgcattatgaaattcttttagtgtgtttttcacctctatcagatcagtttggtcatttcttataatgaccacttcatctatcagctcctgcatcattttattgtactccttagattaggtttcatctttctcctgaaccttgatgatcttcatttgtatctctattctgaattatatttctgtgatttcaccccagttggaggacccctgctgggaactagcgtggtcatttggaagaaagaagacaggctggcattttgggttgccaaagttcatgcactggttctttcttctctgtgtgggctgatgttctttaactgtggtgtaactcgagtaca

SEQ ID NO: 334033 - DNA, 773 bp, Homo sapiens
catgtgagtgtgtggtgcgtgtgggaatgtgtgcaagtgggcgcctgtgcgagtgtgtggtgcgcgtgtgggaatgtgtgcaagtgggcacctgcccatgggagtgtgtggtgcgcgtgtgggaatgtgtgcaagtgggagcctgcgcatgtgagtgtgaggacacctcgtgctcaggtgtcaccaaccccatttaaaaaggaaataactatgatgacaaccagtctctagtgtacgatctgatcgagataccacttcctcatctagcaagtgagcttggctcaggtcttttaaagcacaggtaggccctgaagaaattcagcttcagtcgaacctctgtgcctgcaggtgatgaagacttggggctcattccaatgccaagagcccatgagactcctcctgccagatacctgagtcagagctgagagagcggggcaagagaaccagaaaaattagagagagacaaccttttccctccaggagctcatgctccagccaggagctgaagcagtgggaacgtggcatttaggaacaaactcagaagacgggtgcatggctgttttgatgccccagcaggagcatgacagggctggacgtctatcccattacaaagtacagtgggtcggttcctctgggccaggagctggattctcttcccatctcagtgacagtttgatgtctgtgccctgcagagttgcagattatctgaagctcatggctgtgcctccaggctccctggctggcaggaatgagagcaccaagccaccagagca

SEQ ID NO: 334034 - DNA, 578 bp, Homo sapiens
gggaggcagtagagagaaatgaggtcagaagggaagtggaaaggtaggatcaccaggggtcacgaaggtgatcagatgtcctttggcctcccccccagtgatgggtgccagggagcttggagctgaagtgatgtggtctgacttcacatttttacaggggcactccagctgccaggctggaaatagactgtagggaatgtgcacagaagcggaggcttgggtaggtgtcttcagagtaactctggtaagaggtggtggggcaggcctggtcaaaggtggcaacttttgtgagagtcgagagacctttccacgggtattagagaggctggcgactctaaattttgttagtgatctgtgtcttaaagtcactttcctgaggaagcgtggggtgtgagcacatgaaaggacctactgaagatgcagcaaaatccactaccaggcagggactccaatacgcgtacacgcccagcatgcagagtgggcgctcaggagaaggtgaagaaggagagtttggaagtgacaatttagagcaaagatgacaactgttcaccaccaaggagctgaggtacatgagggag

SEQ ID NO: 334035 - DNA, 636 bp, Homo sapiens
tccgtctgcttcctaaagttcccctgcatgctcaggggggtctgtacggcttttacacccctgaaggacagggagacccccactttaccccatcatcttttttcctaagcatctgaggtcagaattgggggaggacagttgaatgagcatggcaaaagcgactggcccacaccgttaagcaaggcgcgtttcattttgagtggctagtggctactcatggctcaaccaaatttgtaatgacatcagtttaggcattggtctacagcctcattcctgacgctgtttattcagctttgggactccttgaaatagcagctgtacccacaggaccttttacctggtgttgcatggctcacagttcacaccatcatgatgacattccttcatgcttccgctcagaggagagggagtgacaacctagccagcagtgggctcagcctcactgcttacctcagcctgcagactgtcaccagcagctaggactgcttggggtccctgctcctcctgcttgcccaccacttgggtgagcacactcactgctattaatagatcccaggagtcttctcatatcccttaagccaatctgcatgggcccctcctctttcttttccagaaagccatctattagtcccctat

SEQ ID NO: 334036 - DNA, 2727 bp, Homo sapiens
agctggagaacttccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaaaaaaaaaaaaaaaaaaaaaaaaaaaaaaaaaaaaaaaaaaacccccgcgtttttgtttgttgttttctgttctgctcttcgttggggggtcccctctttttctgaccccgcctcgtcgggcggcactctcttttattgcaacgggtcttctcttcccccacaaagagaggggggcgtagcctcccaccggcgggagaggtgtttctcccacaccctcttatgtttcgcgccccccaagaccacggggggggctccccggggagcgacacttctggcccccccat

SEQ ID NO: 334037 - DNA, 2506 bp, Homo sapiens
agctggagaacttccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgccttcgggtacgtcgtctgcttaatttgatgtctatgagcaacccaatctttcctcggatgtcactgttaaattttggtccggagtaaggattgtatcttcactggttcctgtctctgtttccgtaaatcggg

SEQ ID NO: 334038 - DNA, 2380 bp, Homo sapiens
agctggagaacttccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaactgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 334039 - DNA, 2286 bp, Homo sapiens
agctggagaacttccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 334040 - DNA, 2807 bp, Homo sapiens
agctggagaacttccggtgcgtttccgctgtaccggaacgtggggcgaggcggtgagtgtggcctcctggcctctttttcctttcctgattccttgtgtatgtgtggctgggccgcccctcttctcggctcagagtcacggagtgccttgaactaggcccacctcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgacttccaggatacagcaggactcaagtctcgtggcgatgacagccttcaatcaaacatccaaaactgcagttgtgatcattgagacggaaagctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 334041 - DNA, 1716 bp, Homo sapiens
agggttacatggtatagtgcagtatttcctgaccctggagcagaccatccacattagaatcacctggggagcttgttagagctacagatacgaaggccccatcatctctcctccaccagaacctctgagggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 334042 - DNA, 1088 bp, Homo sapiens
agctggagaacttccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgagaaggaacaaggctctttgggagtgggccaaggggaggatattagcagaggtgttttggaatagggagtacatcttgtgttagtccagcagcaactaaacctggctaggaggctgaagatacaggtgtgtctttacccttagccctggagatttcgatttgagagatctggagtggggcttccgcagtttctatctgtctaataaacaaacatcctaggtgaacctg

SEQ ID NO: 334043 - DNA, 2443 bp, Homo sapiens
agctggagaacttccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 334044 - DNA, 2398 bp, Homo sapiens
agctggagaacttccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 334045 - DNA, 2722 bp, Homo sapiens
agctggagaacttccggtgcgtttccgctgtaccggaacgtggggcgaggcggtgagtgtggcctcctggcctctttttcctttcctgattccttgtgtatgtgtggctgggccgcccctcttctcggctcagagtcacggagtgccttgaactaggcccacctcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgacttccactgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 334046 - DNA, 2878 bp, Homo sapiens
agctggagaacttccggtgcgtttccgctgtaccggaacgtggggcgaggcggtgagtgtggcctcctggcctctttttcctttcctgattccttgtgtatgtgtggctgggccgcccctcttctcggctcagagtcacggagtgccttgaactaggcccacctcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgacttccaggatacagcaggactcaagtctcgtggcgatgacagccttcaatcaaacatccaaaactgcagttgtgatcattgagacggaaaggtacaaggcaccccagattatatcacaggagacctgacctagccccagggcaaggaacctttactgaggagctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 334047 - DNA, 2389 bp, Homo sapiens
agctggagaacttccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaaagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 334048 - DNA, 355 bp, Homo sapiens
atgcatggctctcttggaatccagaatttcaagagaattttccaagagccacggaatccaaaattcctagccaaagtgattactgttaaaaattaaccacaaagttttgtcaccaatgtgggcatctaacattttataggttaaaagtagcaccatatatcaaacttctaagctgctgaggtcttcttgatggggagggggaagaatacagcctttagtggaaaagaggctgtttccttggatagggtctctcaaactgcacttgctgctctgattccactcagatcatacttagcactcattcaatgaatattcattgaacccaggacctgattgagaggtggatcagttagac

SEQ ID NO: 334049 - DNA, 1869 bp, Homo sapiens
atgaacgactttgacgagtgcggccagagcgcagccagcatgtacctgccgggctgcgcctactatgtggccccgtctgacttcgctagcaagccttcgttcctttcccaaccgtcgtcctgccagatgactttcccctactcttccaacctggctccgcacgtccagcccgtgcgcgaagtggccttccgcgactacggcctggagcgcgccaagtggccgtaccgcggcggcggcggcggcggcagcgcggggggcggcagcagcgggggcggccccggcgggggcggcggcggcgcggggggctacgctccctactacgcggcggcggcggcggcggctgcggcggccgcggcggccgaggaggcggccatgcaacgcgagcttctcccgcccgcgggccgccggccggacgtgctcttcaaggcgcctgagccggtgtgcgctgcgccggggccgccgcacggccccgcgggcgccgcctccaacttctacagcgcggtgggccgcaatggcatcttgccacagggcttcgaccagttctacgaggcagcgcccgggcccccgttcgccgggccgcagcccccgccgccacccgcgccgccacagcccgagggcgcagccgacaagggcgaccccaggaccggggctggtggcggcgggggcagtccctgcaccaaggcgacccctggctcggagcccaagggggcagcagaaggcagcggtggcgacggcgagggccccccgggagaggcgggggccgagaagagcagcagcgcagttgccccccagcggtcccggaaaaagcgctgtccctataccaagtaccagatccgcgaactggaacgcgagtttttctttaacgtgtacataaacaaagagaaaagacttcaactctctcggatgctcaacctcactgaccggcaagtcaaaatctggttccagaatcgcaggatgaaagaaaagaaactgaacagagaccgtctgcagtatttcactggaaaccccttattttgagagctccaggaagcgccctcaccccagccccactcacccaccctccttcccaccagcctgctctccgcaggcccactgtccttgggtttaatgacgtctcttctctgtggaacttcacgattccttcccacggtcaactcgggacctcccagcgaccactgcagcctgcggacgaggccgggacttggccgagcggatcctaataaggggaaaatggtaaatgcaaacgtcccgttacaattttaccgccagtgtgctgtcgttccccctccccctctccgagtcctcgtggggacacggcggggtctgtaggaagttgggccgggttgggggttgctagaaggcgctggtgttttgctctgagttttaagagatcccttccttcctcttcggtgaatgcaggttatttaaactttgggaaatgtacttttagtctgtcatatcaaggcatgagtcactgtctttttttgtgtgaataaatggtttctagtaaaatggaggttacagcttcaatacactgtatgaattctcctctttgaggtttagtgcctccttaggatattttagtggccagaacccatgcaactgaaaatcgaatgaaatactttttagtcccactaaaatagtagtcgtaccctcccaccacctctaggttacactggttttaaaaatcatgttagtgatgaatttctgaattgacgatgtgaccaagcaatgctggcgctgccttctccaggcagtaaggctggggcagcaggaacctaagaagaaaactcccacccccaccactagtctagtgaacttgggatttctgaaaagacagcaaccatttttaaaaactggttagaaaat

SEQ ID NO: 334050 - DNA, 1144 bp, Homo sapiens
gaaggctctgtagggaaggaactggctctgggtgttttccctgcatttctcttctttcgtttcttaaaagagcataaataattaaagtttggcagggaggaaaagctttcttgcagaactgtagtggcaataaatgaaatgactcagaatcccttccccagtcagcttttacgagagctgccagacagtgtctgttcacgttctccagataccaggggcgccctgacaaagttaaggtcaagttagtgtcttatcttgggtgactcaaaatcaccgcatcgcgtcctggcgctgtgcggaaagctctttctcgcggagcggctggctgcgccccgaaggcctggtgcgctccctgcgtttcgggtggggccgcgcaggcaaggacaaggccacagagtcggggtcttcacgttgccccccagcggtcccggaaaaagcgctgtccctataccaagtaccagatccgcgaactggaacgcgagtttttctttaacgtgtacataaacaaagagaaaagacttcaactctctcggatgctcaacctcactgaccggcaagtcaaaatctggttccagaatcgcaggatgaaagaaaagaaactgaacagagaccgtctgcagtatttcactggaaaccccttattttgagagctccaggaagcgccctcaccccagccccactcacccaccctccttcccaccagcctgctctccgcaggcccactgtccttgggtttaatgacgtctcttctctgtggaacttcacgattccttcccacggtcaactcgggacctcccagcgaccactgcagcctgcggacgaggccgggacttggccgagcggatcctaataaggggaaaatggtaaatgcaaacgtcccgttacaattttaccgccagtgtgctgtcgttccccctccccctctccgagtcctcgtggggacacggcggggtctgtaggaagttgggccgggttgggggttgctagaaggcgctggtgttttgctctgagttttaagagatcccttccttcctcttcggtgaatgcaggttatttaaactttgggaaatgtacttttagtctgtcatatcaaggcatgagtcactgtctttttttgtgtgaataaatggtttctagtaaaatg

SEQ ID NO: 334051 - DNA, 1514 bp, Homo sapiens
atgaacgactttgacgagtgcggccagagcgcagccagcatgtacctgccgggctgcgcctactatgtggccccgtctgacttcgctagcaagccttcgttcctttcccaaccgtcgtcctgccagatgactttcccctactcttccaacctggctccgcacgtccagcccgtgcgcgaagtggccttccgcgactacggcctggagcgcgccaagtggccgtaccgcggcggcggcggcggcggcagcgcggggggcggcagcagcgggggcggccccggcgggggcggcggcggcgcggggggctacgctccctactacgcggcggcggcggcggcggctgcggcggccgcggcggccgaggaggcggccatgcaacgcgagcttctcccgcccgcgggccgccggccggacgtgctcttcaaggcgcctgagccggtgtgcgctgcgccggggccgccgcacggccccgcgggcgccgcctccaacttctacagcgcggtgggccgcaatggcatcttgccacagggcttcgaccagttctacgaggcagcgcccgggcccccgttcgccgggccgcagcccccgccgccacccgcgccgccacagcccgagggcgcagccgacaagggcgaccccaggaccggggctggtggcggcgggggcagtccctgcaccaaggcgacccctggctcggagcccaagggggcagcagaaggcagcggtggcgacggcgagggccccccgggagaggcgggggccgagaagagcagcagcgcagttgccccccagcggtcccggaaaaagcgctgtccctataccaagtaccagatccgcgaactggaacgcgagtttttctttaacgtgtacataaacaaagagaaaagacttcaactctctcggatgctcaacctcactgaccggcaagtcaaaatctggttccagaatcgcaggatgaaagaaaagaaactgaacagagaccgtctgcagtatttcactggaaaccccttattttgagagctccaggaagcgccctcaccccagccccactcacccaccctccttcccaccagcctgctctccgcaggcccactgtccttgggtttaatgacgtctcttctctgtggaacttcacgattccttcccacggtcaactcgggacctcccagcgaccactgcagcctgcggacgaggccgggacttggccgagcggatcctaataaggggaaaatggtaaatgcaaacgtcccgttacaattttaccgccagtgtgctgtcgttccccctccccctctccgagtcctcgtggggacacggcggggtctgtaggaagttgggccgggttgggggttgctagaaggcgctggtgttttgctctgagttttaagagatcccttccttcctcttcggtgaatgcaggttatttaaactttgggaaatgtacttttagtctgtcatatcaaggcatgagtcactgtctttttttgtgtgaataaatggtttctagtaaaatg

SEQ ID NO: 334052 - DNA, 1427 bp, Homo sapiens
atgaacgactttgacgagtgcggccagagcgcagccagcatgtacctgccgggctgcgcctactatgtggccccgtctgacttcgctagcaagccttcgttcctttcccaaccgtcgtcctgccagatgactttcccctactcttccaacctggctccgcacgtccagcccgtgcgcgaagtggccttccgcgactacggcctggagcgcgccaagtggccgtaccgcggcggcggcggcggcggcagcgcggggggcggcagcagcgggggcggccccggcgggggcggcggcggcgcggggggctacgctccctactacgcggcggcggcggcggcggctgcggcggccgcggcggccgaggaggcggccatgcaacgcgagcttctcccgcccgcgggccgccggccggacgtgctcttcaaggcgcctgagccggtgtgcgctgcgccggggccgccgcacggccccgcgggcgccgcctccaacttctacagcgcggtgggccgcaatggcatcttgccacagggcttcgaccagttctacgaggcagcgcccgggcccccgttcggcgggggcagtccctgcaccaaggcgacccctggctcggagcccaagggggcagcagaaggcagcggtggcgacggcgagggccccccgggagaggcgggggccgagaagagcagcagcgcagttgccccccagcggtcccggaaaaagcgctgtccctataccaagtaccagatccgcgaactggaacgcgagtttttctttaacgtgtacataaacaaagagaaaagacttcaactctctcggatgctcaacctcactgaccggcaagtcaaaatctggttccagaatcgcaggatgaaagaaaagaaactgaacagagaccgtctgcagtatttcactggaaaccccttattttgagagctccaggaagcgccctcaccccagccccactcacccaccctccttcccaccagcctgctctccgcaggcccactgtccttgggtttaatgacgtctcttctctgtggaacttcacgattccttcccacggtcaactcgggacctcccagcgaccactgcagcctgcggacgaggccgggacttggccgagcggatcctaataaggggaaaatggtaaatgcaaacgtcccgttacaattttaccgccagtgtgctgtcgttccccctccccctctccgagtcctcgtggggacacggcggggtctgtaggaagttgggccgggttgggggttgctagaaggcgctggtgttttgctctgagttttaagagatcccttccttcctcttcggtgaatgcaggttatttaaactttgggaaatgtacttttagtctgtcatatcaaggcatgagtcactgtctttttttgtgtgaataaatggtttctagtaaaatg

SEQ ID NO: 334053 - DNA, 181 bp, Homo sapiens
ggcctttggacaagtaacaatctgtcatgtatcaatttcctcatctataaaatgagtttttctgagataataactgtacttgttccacctctgagattagggaaattgaagaagatacataagcgttagaaagggatcaaagtaatcagttttattgctggtaaaactggtttgggtctga

SEQ ID NO: 334054 - DNA, 193 bp, Homo sapiens
tgcttaaagcactatgctatataattgttagcaagtatttattattgttaatctgctggcttctggtacagcatcctaaagaaaggctaaagtttctgactctcatcaagaggcctgggggaaagaggttgtaattaggtgtgccaaggccagtgtctggactaggatgatggtagtgggcaaagaaaacagg

SEQ ID NO: 334055 - DNA, 167 bp, Homo sapiens
agttaagtggcccaggctctgtgtagggggtgaggttaacgcaggaagaaagatggtgaggggcaagggtgcaaggattatgttggaatgaggctccccaagtttccctggccctggctggttgtgctgctggcctgaacatctgatgagcttgcaagggtgactcc

SEQ ID NO: 334056 - DNA, 225 bp, Homo sapiens
agacggggttttccatattagccaggctggtctcaaactcctgacctcaggtgatctgcccgcctaggcttccgaaagtgttgggattacaggcgtgaaccaccacacccagcttccagtacatcttttaaacgccttgttaacagttattattgagtttctctgtactcacttgttctgattcttccctctaatgtcaaggctaagagtatgcaataaatctag

SEQ ID NO: 334057 - DNA, 222 bp, Homo sapiens
agggcaccacaccaagttgaagcaagcattccacaatgtttagcgccacgtcacagatacgagagctgatgtcatgattaaggacaagataaacagccttcagaactacctgaggaaaacaagataaacacagcatgattaagttacctgcactccctcttcctaaagagatctgattattctgtttaacccatttccttaggctagtctatgaaattgggt

SEQ ID NO: 334058 - DNA, 211 bp, Homo sapiens
ctcctgctctcaggggcctttcctatatcacaccctagccactaaggtcatgttcacccatttgccatcaaaggtaacattcgtgggtttcagggagtagaacatggatatgtcttattgggggccaccattcagtccctgaaaggggtctttcaaacagaccaaagcacatgaagaggggaaaagacagccacgccaaaggccacagaca
